US006475793B1

(12) United States Patent
Rosenthal et al.

(10) Patent No.: US 6,475,793 B1
(45) Date of Patent: Nov. 5, 2002

(54) GENOMIC SEQUENCE OF RHIZOBIUM SP. NGR 234 SYMBIOTIC PLASMID

(75) Inventors: André Rosenthal, Berlin; Christoph Bernward Freiberg, Wuppertal, both of (DE); Xavier Philippe Perret; William John Broughton, both of Geneva (CH)

(73) Assignee: Andre Rosenthal, Berlin (DE)

( * ) Notice: Subject to any disclaimer, the term of this patent is extended or adjusted under 35 U.S.C. 154(b) by 0 days.

(21) Appl. No.: 09/214,808

(22) PCT Filed: Jul. 10, 1997

(86) PCT No.: PCT/IB97/00950

§ 371 (c)(1), (2), (4) Date: Jun. 22, 1999

(87) PCT Pub. No.: WO98/02560

PCT Pub. Date: Jan. 22, 1998

(30) Foreign Application Priority Data

Jul. 12, 1996 (EP) ........................................ 96730001
May 20, 1997 (GB) ........................................ 9710395

(51) Int. Cl.$^7$ ........................ C12P 21/06; C12N 9/00; C12N 1/20; C12N 15/00; C07H 21/04

(52) U.S. Cl. .................... 435/419; 435/69.1; 435/183; 435/252.3; 435/320.1; 435/410; 536/23.2; 800/278; 800/295

(58) Field of Search ............................ 435/183, 69.1, 435/252.3, 320.1, 410, 419; 536/23.2; 800/295, 278

(56) References Cited

FOREIGN PATENT DOCUMENTS

| | | |
|---|---|---|
| EP | 0 211 662 A2 | 2/1987 |
| WO | WO 94/00466 | 1/1994 |

OTHER PUBLICATIONS

Aguilar et al. J. Bacteriol. vol. 169(12):5393–5400, 1987.*

Appelbaum, E.R. et al., "*Rhizobium japonicum* USDA 191 has Two nodD Genes that Differ in Primary Structure and Function," *J. Bacteriology,* 1988, 170(1), 12–20.

Badenoch–Jones, J. et al., "Structural and functional analysis of nitrogenase genes from the broad–host–range Rhizobium strain ANU240," *Gene,* 1989, 77, 141–153.

Fellay, R. et al., "Organization of host–inducible transcripts on the symbiotic plasmid of Rhizobium sp. NGR234," *Bol. Microbiol.,* 1995, 16(4), 657–667.

Freiberg, C. et al., "Sequencing the 500–kb GC–rich Symbiotic Replicon of Rhizobium sp. NGR234 Using Dye Terminators and a Thermostable "Sequenase": A Beginning," *Genome Res.,* 1996, 6(7), 590–600.

Frelberg, C. et al., "Molecular basis of symbiosis between Rhizobium and legumes," *Nature,* 1997, 387, 394–401.

Horvath, B. et al., "Host–specific regulation of nodulation genes in Rhizobium is mediated by a plant–signal, interacting with the nodD gene product," *EMBO J.,* 1987, 6(4), 841–848.

Lewin, A. et al., "nodSU, Two New nod Genes of the Broad Host Range Rhizobium Strain NGR234 Encode Host–Specific Nodulation of the Tropical Tree *Leucaena leucocephala,*" *Mol. Plant–Microbe Interactions,* 1990, 3(5), 317–326.

Meinhardt, L.W. et al., "Molecular cloning and characterization of a sym plasmid locus that regulates cultivar–specific nodulation of soybean by *Rhizobium fredii* USDA257," *Mol. Microbiol.,* 1993, 9(1), 17–29.

Nayudu, M. et al.,. "Analysis of R–primes demonstrates that genes for broad host range nodulation of Rhizobium strain NGR234 are dispersed on the Sym plasmid," *Mol. Gen. Genet.,* 1987, 206, 326–337.

Perret, X. et al., "Subtraction hybridisation and shot–gun sequencing: a new approach to identify symbiotic loci," *Nucl. Acids Res.,* 1994, 22(8), 1335–1341.

Perret, X. et al., "Canonical ordered cosmid library of the symbiotic plasmid of Rhizobium species NGR234," *Proc. Natl. Acad. Sci. USA,* 1991, 88, 1923–1927.

van Slooten, J.C. et al., "Two $C_4$–Dicarboxylate Transport Systems in Rhizobium sp. NGR234: Rhizobial Dicarboxylate Transport is Essential for Nitrogen Fixation in Tropical Legume Symbioses," *Mol. Plant–Microbe Interactions,* 1992, 5(2), 179–186.

* cited by examiner

*Primary Examiner*—Rebecca E. Prouty
*Assistant Examiner*—Manjunath N. Rao
(74) *Attorney, Agent, or Firm*—Woodcock Washburn LLP

(57) ABSTRACT

The sequencing and analysis of the complete nucleotide sequence of symbiotic plasmid pNGR234a isolated from Rhizobium sp. NGR234. The complete sequence of pNGR234a is presented. The analysis includes the identification of a number of novel ORFs and the proteins expressible therefrom which have been ascribed putative functions.

9 Claims, 630 Drawing Sheets

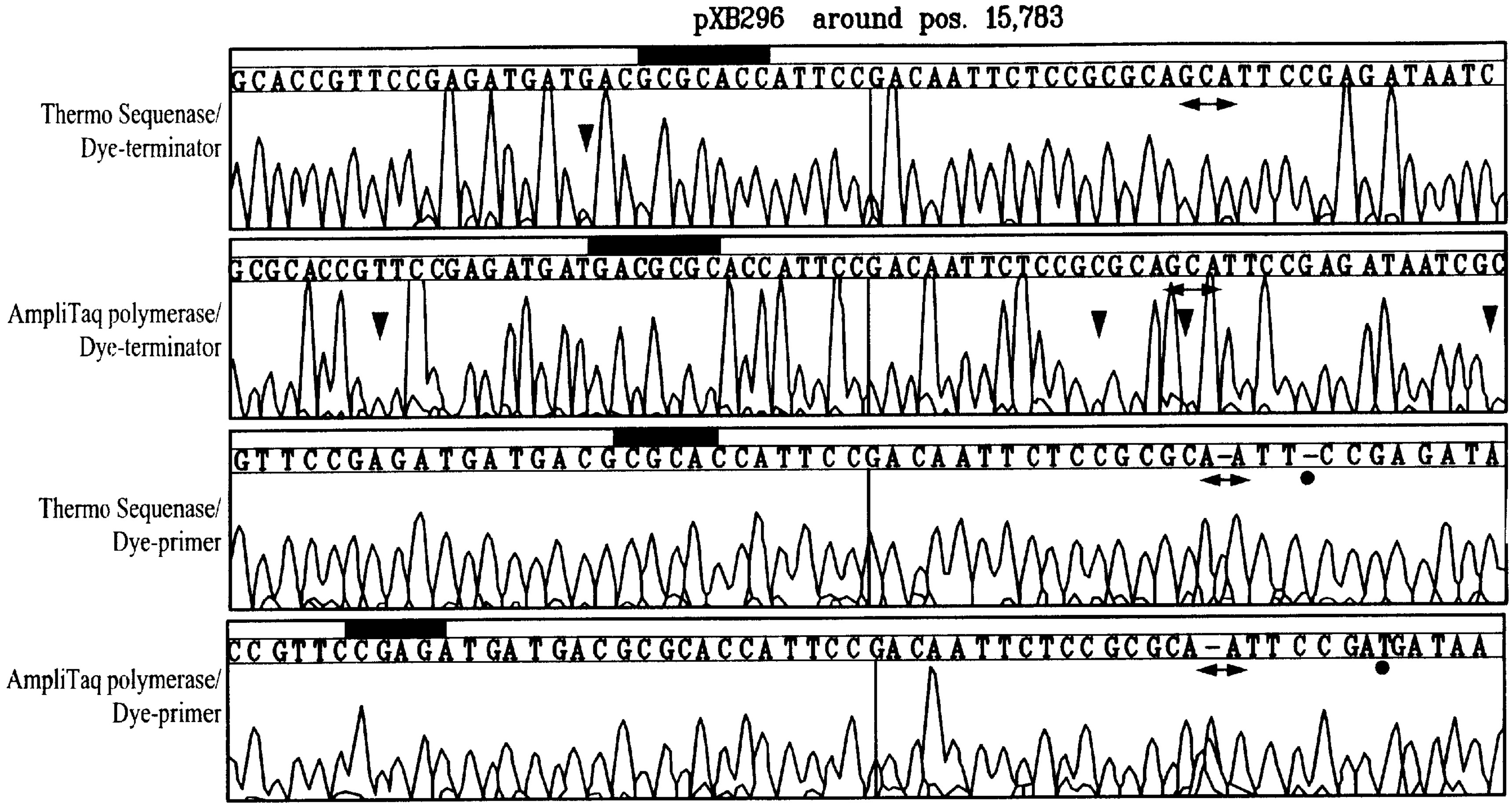

FIG. 1

Comparison of sequences from pXB296 created by different cycle sequencing methods. The graphic outputs (program XGAP) of four electropherograms (traces) with the corresponding sequences generated by automatic base calling are shown around the pXB296 sequence position 15,783 (verticle line in the middle of each sequence). The readings cover a part of the minus strand of pXB296. (▼) Extremely low signals produced with dye terminators; (↔) the sequence GCA, which is compressed in dye primer scans; (●) automatic base-calling inaccuracies.

FIG. 2

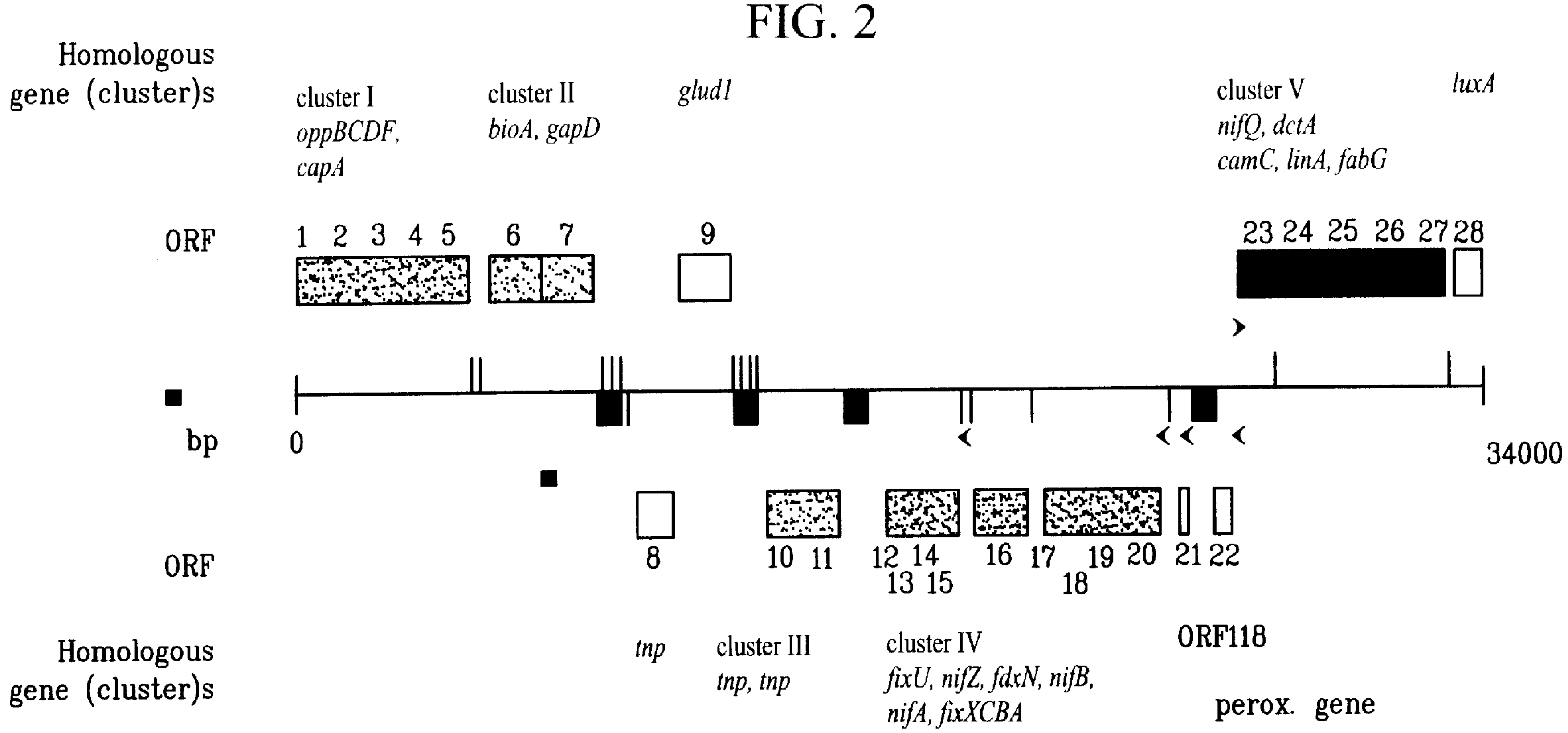

Organization of the predicted ORFs in pXB296 from *Rhizobium* sp. NGR234. Significant stem-loops (1)/stem-loop clusters (■), which might function as $\rho$-independant transcription terminators, are represented. Sequence motifs (open arrowhead), similar to $\sigma^{54}$-dependent promoter consensus sequences (TGGCACG-$N_4$-TTCG) + *nifA* upstream activator sequences (TGT-$N_{10}$-ACA), are located at the following positions on the cosmid: 19,107 - 19,120 + 19,195-19,210; 24,787 - 24,800 + 24,878 - 24,893; 25,508 - 25,521 + 25,567 - 25,582; 26,815 - 26,828 + 26,941 - 26,956(all minus strand); 27,074 - 27,131 (several possibilities) + 26,969 - 26,984(plus strand).

Figure 3

1
gatctcgatt ggcagaaccg gcaccgcgcg ccagctaact acgccataga gcgcgagcag gaagcgcgtg agtacgttgc tgttggcggc gccgccgcgc gcgcggatcg cctcgcgcgc 121
cttcaccata tgagccgcgt cgacggaatc accgatcatc ttgagcgcga agtaagactt 181
cacgcttgcg ctcatatcga agggcccgtc atgcaccagc ggccagccgc cgtgcgcgcc 241
ttgagtgcgg cgcagataat ttccgatttt ggcttcgagc acgacgtcaa tgggctcggc 301
caggtaatga cgtagcagga tgtattcgga agggatggtg gaatccgctt caagctcgaa 361
cgcccaatgg ccgtcggcat gacgataagc gagcagcgcc tcagtggctg aggcgatgct 421
catttccagc gcggcgggat cgatggcagt gcgatttccg gaatgcttat tcactgactt 481
cctgcgtgtt cggcagcgtg caaaaccgtc tggatttatc aatcaagtgt ttgtctctga 541
aagagccaga tcggcggcac ggttacccga ccgcaccgat ccctcgatgg ttgccggcaa 601
accggttgcg gtccagtcgc cagcaaggaa caggtttttg caaccggtca cgggccctgg 661
acgtagcgcg ttctgctccg gggtggcctg gaatgtggcc cggcgctcac acacgatctg 721
ccacggcggc agctcgcctg agatcccacc ggcctcgcac acgtcgcgcc agatcactcg 781
cacgacctcc tcacgcggaa tgtcaagcag gcggtcgcca ttgctaatgg tgactgaaag

Figure 3 (Cont.)

841
ccgctgcgga taggcgaaca gccactccac gagcccgccg accacgccca ggatcggatc 901
cgcaccgact ggcggatcga agcgaaaatg ggcattaacg acggcgcgga attcggtcgg 961
ggttttcagg ccgggcagga gcgtcgcggc cgcccgtggc ggcacggcga ggatcacggc 1021
gtcgtcgggg ccgaccgcta tcttgtcgtc accgaaatca agttcgctga tgatctcggc 1081
cgatttggca agcttgcgca gtttatggct gaggcggacg gtggcgcccc gcctctccag 1141
gagcttgacc gccggctcga ccagaacggc gctcagtccg tcgcgcgcga ctagcggacg 1201
gcaagcctcg ccgcccgcga gcagcgtttc ccgtacgatg gcaccggcaa gccctgccga 1261
gccctccggc ggatcgcaat tcagggcggc gagcagcagc ggccgcacca gacgccggta 1321
cagcgtacca ttgcagggta tagtgtttcc gaccagttca tccgcgccgg cccataggat 1381
tggcgcgagc ttcaggtagt cccacagcct ggtgtcgggg acgcgacgcg ccttgtggaa 1441
cacccaggtc ggaagcctgc cgccgccgag atcgacctgc cagcgctgta cggtggagat 1501
gtcgacgaag ggaaacttgg cactcgtcgg accgacaaga ccggattccg ttccgatcgc 1561
acgggcgtag ttgcgcacat attggttgcc cgatagaacc agatggttgc cgttgtcgat 1621
ggtgagattg gttgcggaat cgaaaaagga gcggcatcga ccgccggcct gttgcgtcgc

Figure 3 (Cont.)

1681
ttcatagaca tgcaccggca aacctgcatt gctcaactgc acggccgcgg aaaggccgga 1741
gatcccggcg ccgataatgt gaacattttt tggcatcaca acatcaaggc gtaacggaag 1801
agaatggcgc gctttgtgag attggttaca cgcaccggtt cccggggagc cgcaaaaccc 1861
cttatcagca gcaggtccaa gatcgcgcgg taacatttgg acatgatggt gggggcgcgt 1921
actattctgc gcgggttgca attcatgatc tcgtcggatt cggcaaaatg catcatcgcg 1981
cgttgggcca gcggtgcgca cgccttgggc agcgccttgt cggcgatgac tttatgtggg 2041
tcgctgctgg tgataccggc gtgatcgagg ctttcgcgtg gtatatagag ccgacccagc 2101
ccagcatcct cgtctatgtc gcgcaggatg ttggtgagtt gcagcgcacg accgaggtga 2161
tgcgcaagtg caatgccatc ctcctcgctc aagccgaaca cacgcaccga catccttccc 2221
acggcgctgg cgacacggtc gcaatagaga tccagggttg ccattttggg cgcgcggatg 2281
tcttgtagta cgtccatttc catgccgtcg acaacggcta ggaaatcctc tcgcttcagc 2341
ccgaaggtcg ttaccgaggc gagatagtcc tttagccgcg gcggcggtac acattggtag 2401
agcgcgtcaa tgtgatcgcg ccattgctga agtgcagcaa ggcggtgctc gcgcggttcg 2461
tcggagtcgg cgatgtcgtc gacctggcgg cagaagctgt agatctggaa tatcgcctcg

cgctgcaccg gcgggagggt acgcattccc agatagaacg agctgccaag ggccgtagag 2581
cggtggttcg cgtgggccgc cgcctccgcc ctcatacgtc gacagtcgtc ttgaatcgcg 2641
taccgcggcc gaacgcacgg cgcgcggctt cgtttgccat tgcgccgacg ccatggagca 2701
gcagctcaag cggcgacaga tgcacgcgct cccttagagg atcgcgcatc ttcagcatcg 2761
acacgatctt atcggcaaaa gacagtatga cggagacctc gaaccggagg cgaaagtcct 2821
tcacctgcga caccagcgct ccgcccccgt tgagcagcac ctcggccttc gctgcgagag 2881
agcgcaggca ttgtagcatc tgcaacgagg attttgcggc gcccagctct tcgatggagg 2941
cgccgctggc tgaaagcgca tcgcgcggaa tatagacgcg attgagatta aggaaatcct 3001
tgccgcaatc ctgcaggtgg ttacagacct gcagtcccgc gcacaacaca tccgatgccg 3061
gccacgtcgc ggcactttcg ccgtggacgt cgagcacaaa tcggccgacc ggcatcgccg 3121
agtatcggca ataatcgatc acctcgtccc agttctcgta acgctgctta gtcacgtcca 3181
ttcggaaggc ggtgagcaga tcgagtgcat gacgcggcgg catgccgcgt cggtcaagcg 3241
cagtgcgtag gtgtacagct tctgctcgcg tttcgccctt gccgagcagc tcggcttcca 3301
ggaggtcgag gtacagaagc ttctcgtctg gcgcgagcgt cgcgtgatcg gcaatgtcat 3361
cggccatgcg gacgaatcgg tagaaggcaa gaatcagcgc tcggtgccgc ggatggataa

Figure 3 (Cont.)

3421
tccacgacgc aacggggaaa tttttctcgc ggtgcattgc gtccgacctg gggccgctgc 3481
cgctcgtcat ttagcaccat cgtcggtttt gcaggcgttg gatgctgctg aaatgcagtc 3541
gggcccccga ataaatcgta caatccacga aggtacggcg gcggccaaag acgttatcga 3601
ccggcgcgcg tttttatccc cgagaattat ccgatgcgaa tctgtttttc gagtatactg 3661
attcgttctg acgaattctt tgctgaaagc gtcggatgag actatatccc agtagctaaa 3721
ggcgattcga ctaccgcgca ttatgaatac accacatccc tgccatgcaa acatatccca 3781
ccactcaatt attacgcggt catcttcttc gtagatgaac tccggagcgc aaatcctctc 3841
cgcaatggcg cgatttggtc gaaaaatctt ttggattgcc gcgcgtccta tcacggggcg 3901
ctgcatcggc cagaggctca ttgcattttc gtggtacagc tcagccaaag cgatcgcatc 3961
acccttattg aatcgtcgaa tccactcttc gaccgtcccg cgcgcgctca ttgaaatgct 4021
cctttctcaa gacctttgct accatcggtc cgtcaggatc cggcattttc cagctgtcga 4081
ttcgatagcc agagggatat cgcccgactc gatccccaaa cataatgagg cacaaagcgg 4141
cgcacagcga ttgctgtgcg agcataagcg ccgcgtttcg ttcgttcagt cattgcaggt 4201
gatgtccacg gtgatcactc gatgccgctt ctaaaagcga tcggtgcacc ttcaacgaaa

Figure 3 (Cont.)

4261 gtcgcggagc cccacgcagc gtggagaaac tcgcgtatgg gtcactggac gggttgtggc 4321
cgtgtttttt gtaggaaacc gcgactttgg caaagctcga actcaccctc tcagttgcgc 4381
gcgcgacgcc cttttcaggc acggcaccgg cccacgctag tgttgctgaa atacaaccgt 4441
gatccgagtg gaaaagcggt ccaccggaag agctaaatca gatgtatttt tcaccagagt 4501
ttcacatagt ctcgctttat tgaaatccat tttttcaatg acataaatct atacggtaga 4561
ttcacagccg agtatgcttc agccacaggc ggttctgcag tcagaacgtc gcggttctca 4621
atttgaggag ttatcagtga tgtttaagac agaacgaggc tgcgatcgtg aaggaatgga 4681
tgagcgtttt ttcgagtgcg gtgtcgcgcg agaccggtgc gccactggca gacagtgtag 4741
gtcatcgctg ctccggtcaa tgtcacggcg aagaccggca cttgtcctgg ggccggcggc 4801
gcctatccac tgggaacaac ggcggtcgag cgggcctgtt tctacctgcc aatgcgagcc 4861
tgatcacccg taccggcgct gtagtcggct ccgagtgcag cgttcaggca ggcggtatat 4921
tttcacggcc ccccgtccgc cgtcgattac gatgctgcat cttcaggcgg cacaaatctt 4981
gcgccgacga accgcgaact cgtcgacgcc gttgatgagc gggtaggggt gatcgcggaa 5041
gagaccgggc ggccagacgt ttgcggaacg cacaagcgac tcgcccgtga cccgcaggcc

Figure 3 (Cont.)

5101
gatggtgtgg gagggagcgg cgccgtgggg cgtctttgca aaccggtgtc agtgccagag 5161
tcgcgacccg ccttaattat cagccacatt gctgacaaac gattcatagg atttggccag 5221
tcccagctcg agcgaggtct tcgggcgcca acccatcgac acgagtcttt cgctagataa 5281
aagctttcgt ggcgttccgt ccggcttgga tgtgtcgaag actatatcgc ctttaaaacc 5341
aacaacacgg cagacgatgt gggctagttc aatgatactt atttcccccc cggagcctat 5401
gttaatgtgt tccgtttcgg aataatgctt aagtaggaag accagggcgt cggagcagtc 5461
ttcactgtac aaaaagtctc gagtaggtgt gccgcttccc catatagaca agcacccaag 5521
gtctttaatc tttgcctcat gtgctttgcg tattaaggca gggacgacgt ggctggagtt 5581
aagatcgaac ttatcgcgtg ggccatagag atttgtcggc atggctgata tgaagtttgc 5641
gccgtattgc ttacgatacg cttgacacaa cttaatgccg gcgattttgg cgatcgcata 5701
ccactcgttg gtcggctcaa gtggtccggt taatagagcc tcttccctta tgggctgcgc 5761
cgcatacttc ggatatatgc aactcgatcc aaggaaaaga agcttttcaa cgccactgcg 5821
gaaggagccc tcaatgacat tagcctccat gataaggttt tgatagatga agtcagcggg 5881
catagtatca tttgccagga tcccacccac cttcgctgcc gccattatga ccgcgtgcgg

cttttccttt aatagaaatt tctcaacttc ctcttgccgc gtcagatcaa gcttttgcct 6001
atctgcaacg atgacttcgc aatcctcgga ggcaagcgat cgaattatgg cgctgccgac 6061
catacctttg tgtcctgcga cccaaatacg ctttccgtct agcaaataca tcggcatctc 6121
gcctcttact gtcgggtgcc cctcaaataa gagagatctt cccttaccat ttcgcaagca 6181
agatctctca cacttgtctc gtgcctccag cccaaaacct gccgggcctt ggtggcatcg 6241
cctaaaagta aatctacttc cgtgggcctg aaatagcgcg gatccaccgc aacgacgcat 6301
ctgcctgtcg cggcgtctat gccccttct tcaatgcctt ctcccaccca ttcaatcgtc 6361
attccggttt cctcgaaggc ccattcgaca aacgtgcgaa ccgatgttgt caccccggta 6421
gccaggacat agtcgcctgg tctatcctgt tgacacatca tccacatgcc ccgcacatac 6481
tcacgggcat gtccccagtc acgttgagca tctagatttc caagataaag gacctcttgt 6541
ttacctagac tgattgccgc tgcagcccgg gtgatcttgc gagtcacgaa cgtctcccca 6601
cgaagcggac tttcgtggtt gaaaagaata ccgttggagg catgcatgcc gtaagcctct 6661
ctataattta cgacaatcca gtacgcgtac agctttgcgg ccgcgtaggg tgaacgcggg 6721
tagaatggcg tcttttcgtt ttgggggctc tcttgagcca gcccatatag ctctgaagtc 6781
gatgcctgat aaaagcgagt ccgattggtc agcccaagaa tccgaatagc ttccagcatg

Figure 3 (Cont.)

6841
cgcaatgtac caattgcatc ggcgtttgca gtgtactcgg gggtttcgaa gcttacctga 6901
acgtggcttt gcgctgcaag gttgtagatc tcatgcggct gggtttgctg aacaatgcgc 6961
agcaaattgg tcgaatccgt catatcccca tagtggagaa aaaatctcgc ttcaggatcg 7021
tgacgttctt gataaatgtg ctctatccgt tgagtgttga atgatgacga acgacgcttt 7081
atgccgtgaa caatatagcc ttcgtccaac agcagttcag caagataagc cccatcctga 7141
cccgttacgc cagatattaa agctactttc cggtctgtca ctttgtcgaa tctccagtga 7201
tattcctgcg ggagagggcg tgcgctaggg cagctggtgt gaaggaaatc gtcgtgcttc 7261
ggcgacagag cgggcctatg gaggcattgc ggttttcaaa gcagtattgc cggagacgtg 7321
cgggccgggg caactgggca tgaggcgctc gtgtcccttg gagcgcgccc aagtttctcc 7381
atgactgctc ttcaccacgc ctagaattga ggtgacgatt ttcattcaag aggcggtatt 7441
tgttgaagat ctttcgatca cgaccaggcg actaggatcg ttcagatcaa actcaataac 7501
ccttgggaca gaaaggcgtg cgtaacgtgt aaaggcgctt gtcggaggaa accgaatgac 7561
ggtgtcgcaa agcccaagaa gatacatctc gacgagggcg gaaattccgc cctcaacccc 7621
gagatctgcg ctgtgtaatg ggccagactg atccgctcgg aaacttttcg ggatcgtgag

Figure 3 (Cont.)

7681
aagatcgggg aacctactcg acacctggtc caatacccgc gcgctatcgg tgcacaaaat 7741
cacccgcaca ggcttcgggt ggggcaacgc tttggcagca ttaatggcag tgcacacttg 7801
atgcacggca aggtccggat cggcccagta gggtgcatgg tccataacgt cttcgccgtt 7861
accatgccga acatgaaccc cgatcgcact gtacccatag aagtgctcct gatagatagc 7921
gtctatgcga gcctgaattt cagcccgagg cttgacactg cagaaaatct gccgctctgc 7981
ctcctcgtcg cagcgccaca tcaaacacgc atcacacact accgtgttgg cctcgacatc 8041
atcttgggcc tggaaaagtt catcgagttc gtctcgctct cgaaaaacct gagcatctgg 8101
gcggtaaaca cattcaatcg caggtttatt ccaccaattt gggaagaatg gtcctgggaa 8161
ggaaaactcg ttgacccggt tatcgcaaat aaaagggaca cctgcgatat ccttgattgg 8221
ttcaaaaaac accggaaagg cgtttgtgaa gggctgatca aggtagcagg acccgcgcca 8281
gtcaacggct aacgttcgcg ccgtcctttg ggcgtagcgc caagcggccg ccagcgacca 8341
cagacagtca ccgaaaccag tacgtctccg agagaggaca tatcgattgt acaatgctgc 8401
ccgtccttag tgccgccgct ctgacttact gtcttctacg gatttccaat caattcagag 8461
cttcctaatg gagttcggca acatcagtaa aatttatatt ttgaatggca accatccaca

tattggatgt aaaggggacg tgtctttcag ggcttatctt cacgttaggt ggcgaaccat 8581
cgacgctagc ggtaacagat ctgcatatca gcaaagccta acttacacca ttgaactgtt 8641
aaggaccgcc agtccctgag ccagcaaatg ttcggcagca tctgggtcgt ctgcctcgac 8701
gtagcaacgc agttcaggcg catttcctga agggcggatg tgcaggatac ggccgccttc 8761
aaatgtcagg cgcaggccat ccacgtcgtc cgtgcccgcc acgcgaccga tccggctgaa 8821
taaatgggaa acattagctt ttgacgcttt caagaatgcc actagggcgt cgctcctatc 8881
gaacggatag ttctcgatcc ggccggacaa agcgactggc aaacgatgca tcgcgacgat 8941
ccccgagagg ggagttttgg cctctactgc catgtggagc gctgcaatga tgggaaggac 9001
gcagtcccgg gtcggcaagg cgggaagcga cgcgcctccg aacgagaagt tcgaacctag 9061
catgacgcca ccgttggcct cgaagcccat cacccgctgc ttgccacggg caaccgcctc 9121
agtcatggct gcaatgacgt aaggtgagcc aacgcgggta cgcaccacct cgacgccact 9181
cgccgcctcg atcccggagt tgctggttat tggcgtagca ataagcttgg cctccagcag 9241
ccttgcgcaa ataagaccga gcagatcacc gcgcaatgga gttcccgttt catccgttag 9301
caggggccga tcggcatctg cgtcggacga tacaatggcg tcaaaggcga actccttcgc 9361
ccaggcagcg agcatcttac atgtcgccgc cgaaatagct tccgtgtcaa cagggatgaa

Figure 3 (Cont.)

9421
gacctcagat cggcctaccg gtacgacatt tgcgccatga ccttccaaga tggtggtcaa 9481
aatatcgcgg gcaacgctgc tgtgctgata taagccgatc tttagcccct taaggcccga 9541
ttttggaagc agcgtttcgt aacgttggat atagaagtca gttgcttcgc tggagtggtc 9601
ggcgccgcgg ccacactcaa ccctggttgc atctgcatcg gctgaaagct gctccgccaa 9661
cgccgtaatc gcctgctcgt cggccttgtt gatctcaccg tcaggcagat agaacttaat 9721
gccgtttcgg tcggccggaa tatgcgagcc tgtgatcatg agtgatgctg caccgagttt 9781
tcggccgtac aatgcaagcg ctggtgtcgg cagccctccg cagtcgaccg gcaccattcc 9841
cgcccgggcg agcgccgcca tgcagatagc ggcgatttcc gaacttgaat cgcggaagtc 9901
gcgaccgacc aatacggtcg cccctggcgc gacccgtcct ctgtcgagga gcatcctcga 9961
aaaggctgta gcatagagcg ccgacacact acccacgagt tctgttgcca acccgcgcag 10021
accacttgtg ccgaatttgg gacccattaa ctagcctttt tttgccgggc agcgttcagc 10081
aggtagtcga cgccaccggg gcaagccgaa tgaattcgca tccactaatg agattgcttc 10141
gctctcgcca cactgttatg aagcttccat caaacgcaat caaaaatgac accatgcttc 10201
caaagattat cccagctatc atggcagggg gtaggggcac aaggctctgg cctctgtcac

Figure 3 (Cont.)

10261
gcgcaactgc cgcaaaacag tttctaaagc taatcggcga ggaaacgctc tttcaagaca 10321
cgcttaagcg cgtttccgat gccaaagttt atggagcacc actcgtcatc acaaatgagg 10381
aatttcgctt cctggttgcc gaacaggcgc gcgagctcgg ggtcacgctt tccagcatag 10441
tacttgagcc ggtgccgcgc aacacggcag ccgcagtagc cgtcgccgcc cggatcgtgg 10501
ctgatcggtt tggtgaggac gcgctattgc ttgtgctgcc gtcggaccac gcgattacgg 10561
tagacgatac ttacaagaaa tgcgtgcgct ccgcctgcat cgccgcagcg gagggcaagc 10621
tcgtgacgtt cggtattcaa cccacttggc cagcaacagg atacggatac atcgaacgtg 10681
gcacttacct tggcaaggac gtccatgcgg ttcaatgttt tgtcgagaaa ccaagtctcg 10741
aaaaggcggc ggctcttttg gagaccggca attactattg gaactctggg atgttccttt 10801
tccaggcggc cagcattatc gccgaacttg aggaacatgc acccgacgtg ttgtcggcgg 10861
tgcacgccgc ggtcaggggc tcaacggtcg acgccgattt tatacgactt gccccggaga 10921
gtttcagcca agcgccatcc atctcgatcg actatgcact gatggagaaa accgcaaacg 10981
ccgccgtggt ctgctcggat tttgcttggt cggatctcgg tagttgggat gctgtatgga 11041
agaatgagga gcagaatgct gatggtaacg tgctcaaggg caatgttacg gcctgcaaca

cgaagaattc gcttgtgctg tcgcataccg cgcatctcgc tgtacagggg atggatggag 11161
ttgcagtcat cgctagcgag gacgcagtct tcgtcgggcg actggaggag gcccatgaga 11221
tcggaaactt ggtgaagcgc ctcgccgcgg acgaaaatac ggcacgtctt acggaattgc 11281
acccaacttt gatacggcca tggggcggct acaccactat gcttaacggc gatcgcttcc 11341
aagtaaggcg gttgttcgta cgccctggga agatgctttc tctccacaag cattttcatc 11401
gatcagagca ctggatctgc gtgaagggca ccgcagaagt gacaatcgag gatcgagtaa 11461
cgatcctgca cgagaaccag tcaatctaca tccccgaggg ggcgatacat cgcttgggca 11521
accctggcaa gatcatgctg gagttggtcg agattcaaac tggtgcctac ctgggcgagg 11581
acgatatcat ccgcgtcgca gacgaatcga gaaatgaaat gccagattcg aggcgtacgg 11641
gcccataggg atagcgtgcc ctttgcgcag tccggcacct tcgcacgcat tacggtatct 11701
ggagcgagga cgtggtggca ccatcggcaa gcgttgcacc ggcggccgcg gacgggtctg 11761
acgacatgcg atggataccg ccctctgcgt cgacacgatc gtagatgcgt gttctcctcc 11821
gtgggcccgg cacgatcgtt ctcctgcgca acgcatacct cgcgacgagg taggccgaaa 11881
aatccggctt tcttcgcgcg cagcatttcg agacgacctt tctcgacggg cagatcgccc 11941
ggcgtctgcg acccgtccgg cttctttttc tttgagcggt ttctcgcagc agcaccgctt

Figure 3 (Cont.)

12001
gcacgcggct ccattccggc ttttttacc gacagatcag ctatgcgctt gaagcgctgc 12061
ttgccgtccc gtctggcgga aggcccgcga ggaacggcga aaaggcggcg ccgaagcccc 12121
tgcattgtta gtggcaaggc tgttgcggtg ggcgttgacg gtttcgctcc ggctcgatcc 12181
ctacggtcga aaagacgaaa tggcaggagc ggtcggccgt tttgccacaa agcctgttct 12241
tcaggaggcg catgcaagag ggcgggcgac ggcatgaagc cgtgaatgca cttgacttca 12301
gattaattaa gcgttttcta acgatttgca taattgatcg ttcggatgac aaccatccgc 12361
actgtggatt cgccagaaca tgcgttttaa gggccttgat ctcaatctcc tcgttgcgct 12421
cgacgcactg atgaccgaac gcaaactcac ggccgctgca cgcagcatca acctgagcca 12481
gccggcgatg agcgcagcca tcacccggct tcggacctat ttccgcgacg agctatttac 12541
catgaatggt cgcgaacttg taccaactcc gcgagcagaa gcgctcgcac ccgcagtccg 12601
cgaagccctg ctgcacatcc atctctccat catttcatgg gatccgttca acccagcgca 12661
gtcagatcgc agtttcagga tcattctttc cgacttcatg acgctaatgt ttcttgaaag 12721
ggttgtggtg agagtggcgc gggaagcgcc cgccgtcagt ttcgagttgc tgccgttttc 12781
cgatgagcca gatgagcttc tccggcgtgg tgatgtcgat ttcctgatcc tgccagaaat

Figure 3 (Cont.)

12841
gttcatgtcg cacacgcatc ccagagcgaa gctgttcgat gagagattcg tgtgcgtgag 12901
ctgcccaacg aaccagaagc taccgccgca gctctccatc gacaactatg tatcaatggg 12961
gcatgttgcg gcccaattcg ggaagcagcg gccttccgtg gaggaatggc tattgcgcga 13021
gcacggattg cgaagacggg tcgaagtcgc cgtgccgggt tttaccatga tcccgtcttt 13081
tttgtcgggc actgaccgca tagcgaccct cccgttacga ctggcgatgc acttcgcaaa 13141
agccattccc ctgcggatca ccgaacttcc gcaacccatt tttcccgcgt tcaccgaggc 13201
tgtccagtgg cccgcgcctc acagcagtga tccggccagt ctctggatgc gcgagatatt 13261
tctacaggag gcgtctcgcg ttgaatttca atccgaaact tcggcgcatg ctctatctaa 13321
agccgacggc gcaattcgcc acccttgagc ccgcaactgc acggtcggct cagggtcgag 13381
cagtttggct gcaggttgcg gcctaccaga ggggctcgca cggcccgagc gtaccgcatg 13441
ccacactccg accattttcg gcctatgcgc agcattagct cttcagcttc agcagccggg 13501
agaccatctc attcagcgtg atatccttcg atacctcgat caaaccgcgc atgggcatta 13561
aggcgaggtt cctactgtcc gccatgctac aagtcactcg caagttgccc ttccggacgc 13621
tcccaatcca gccaatttgc ggtcggaacg ccaatccaac cgcctcgcag cagcctccgc

cgacagcccg ttccgtcttc gatactcggc tctgaagatc gtgactcagt gctcttccat 13741
tgcctcctga ttctaagaaa agaaccgaga ctgcggacac ggagatgcct caattgagtt 13801
gctcactttg gagttgagct gtatcaaacg ggtgccctcg acaaaggcca tattcgatat 13861
agcggatccc agtaaatcat tggtgaaacg atccttcacc aggagtaagt gtgttgagtg 13921
ttgaccctga gaagaaaaga gccaaagcga acgctgtgga tatttacgtc ggccgtcgaa 13981
ttcgccagag gcgacgatgg cagaatatgt cccaagcggc cctcggagaa gctatcgggg 14041
tgacgtttca gcaggtgcaa aaatatgaaa agggctcgaa ccgggtaggt gcgggccgac 14101
ttcagcagat atctgatgca ctggaagtgc acccttccta tttttttgag gacatgcctg 14161
acgacactca gtcgataggg cagggcgccc ctaatcaggc ctatatcccg cccgaagtga 14221
ttgagttcgc tgcaagcgac gaaggggtcg agctcatccg ggcgttctcc cgtgtcggca 14281
atctcaacgt gcgctgtcga atcgtgaagc tgctcaagtc tctcggcgaa cacgactggt 14341
aagcatgaat tcgcccattt ctgagtcgaa cgcggctacg ctctcggaat gaaatcaacc 14401
gtaagtgaca tcgccatggg acgcttgcat tgactctgta gctcattgag ttcaaatcat 14461
acaagtgagc taggggagga aatcacagtg gctgacgaga gtaacacagg accagttgcc 14521
gcggctgagg cggttgccga aacgcaagca ccagctggca aaaggaagag ttcgtcgcgg

Figure 3 (Cont.)

14581
cgtcaaagaa cggctgccgg acaagttgcg gaatcaaaga cgactgctaa gcctaagaga 14641
tatagcgaga cagaaagagc tgacaagctc aatctgatcg aggccgaagt ggctcaaggc 14701
aatagcaccc taaaggacgc gatcaagagc gccggcatat cggagcaaac ctactacgtg 14761
tggaagaaat ctgctaagcc tgccgatcga aaaccagagg agtctgtggt ggccggcgat 14821
gaccttgccg atctcattca actcgataag gaaaacttga ggcttcgcaa ccttttgtcg 14881
gacaaactgc gtgcggaaaa cgccgaactg cgcaagagac ttgggctgga ttagttcaag 14941
agtagcctct caaggctgtg gtaaggcgcc ctgccggctt ccgaaaggga cggcgtgcct 15001
agccttacgg ccacttgcat cgagtccgaa atggcggtat ttggccgaat ggtaaaggaa 15061
tgtcgtggcg cgttttggcg ctgatgagtc gtggattgct tgcgagatac atatgaaaac 15121
accaccacgg aggtttattg tcgaattcaa gcaagcacgg cggcgatcaa aggaacgaac 15181
gaattcagtc tggggaaaca cggaccttaa ggctttgacc cgcgaagtgg aagagatggc 15241
tccgcatttg ttcaacttaa cggaagagcc agtatcccct aacgtagcct acggtccgcc 15301
ggccagcccg aatgcagagt ttctcattgc agacaaagag aatatcgggc ttgggccaga 15361
agccgtgaca ccggccgaag gttcggaaaa cgcgttctcg ggctgttgc aggagacgcc

Figure 3 (Cont.)

15421
accggtctcc cacacccgaa caaactccaa acagcgcatt tcgcgaaagc tacccgagcg 15481
gttgtcattg gacgtgcgtg agaatgtaga acgcccgatt tctcgcggtg aattggccac 15541
tctcgaagca gaaaacaagc gcctcaaaag gctgctcgct gaacggatcc ttacccaaaa 15601
cttgcaactc aagaagatgc ttgatcggtt taacctcaat tgacgatgtc gcatccgcgc 15661
gaaagtctta ggaatctctt gggggccggc gttttagcaa tcgctgatag ctcttcaatc 15721
ccacctcaat gacacagttc aggaccttcc tccatgtatc tagccatagc acgccaaccg 15781
aatatattca aacaaacctg agcctacggc agaattaatg gtttttaat agacttggta 15841
gctgcggatt aaaattatgt tttgacatat cctcgatcgg tgttaatcca ctaaatgaga 15901
agtgtcgtcg cagataaata ctttgacgaa attccagctt gggttgtgat tcttccctgt 15961
tgctttgagc cgtcagccag ctcagcgcct tggtggcggc ttcccatcac gacttgagcc 16021
ttgatgttgc ggcggagcct ggctcctgtg caatgaccgt ccagtttcaa gaggcaagtg 16081
agttcagcgg cattttctcg cacgtttcct cctgaaacgt cgttttggga tatgttgcta 16141
agatccgata ggagaagaag atgacagaaa ccacgctcgg tgcgagcaac gaacttttgg 16201
cagaactgac ggcagaaatc gtagccgcct atgtcagcac ccacgtggtt ccgggtgccg

agcttccgac gcttatcgct gacgttcatt cagcgctcaa caatgccact gctcccgcgc 16321
cggtgattgc tcccattgag aagccgaagc cagcggtctc gatccgcaag tctgtgcagg 16381
acgatcagat cacctgcctc gaatgcggcg gcgccttcaa gtcgctgaag cgccacttga 16441
tgacccacca caatctgtcg ccggaagatt atcgcgaaaa gtgggaccta cccgcggact 16501
acccgatggt cgcgcccgct tatgcggaag cccgctcgcg tctggccaag gagataggcc 16561
tcggcgagcg ccgcaagcgt cgtggtaagt agaacgttat cgccggcggc gatcgctgcc 16621
agctacgcgc cacgccttta atttgcgcga aatgctatgc agaatgcggt gtttcggccg 16681
caccttccag atgcacggcg tgattgacga atgttgaccc cgaacgaaag cttggacata 16741
tgtagatttc acagcttacg cttaaatcca gcgatgacga gacggtgcgc cgcttcaagg 16801
ttttcattaa tcttgtcgtt ggcgaagccg ccaagttcaa ccgtctcgat ccggaggtcc 16861
atcttcgaga tatcctcacg cgcatcgccg gccatccgat caacaggctt gccgaatggt 16921
taccgcggag catgcggcat cagggtcgac catggccggg cctgccaaca cgacactcat 16981
gcgcagcgcg cctgcggcct tcctcggtgg cggcgtcatc ggcccgcctc cgaagagccg 17041
gtcagcttga cgacatcgac gaacttgcgt cgcgcgtgag caaggcagaa cgccagccgc 17101
atgggggcga cattgctctc tcccatcacg cgcgccgacg cgggcgcttg cacaatgacg

Figure 3 (Cont.)

17161
ctttcaccgg cccggcatgc atagcttggc cggatcgtct gctttacccg gacaaccgcc 17221
ggcacgatgt cgagcgcctc actgacgtcc gtgccgacgc aatgaagctc gaacgagcag 17281
cacgggcaaa tcttgctctc cggctcgatg agctcttcat accgtgggag gtgcctgggt 17341
aaacggccga tgttgcgcga cggtgaccgt cgctcctgtt ttggcccttc agccacgggt 17401
gcaacatcgt cattggccgc cgcgggaatg tcggtgagat cgccaaggtc aagcgtcgcc 17461
tgcgtcgggt cgatcgccgt catcttctcc gatttcggcc caaagagctg ctgctccagg 17521
aaggcaacgc gcgccttgag gtcggcgttc tctgcatcaa gcgagagaat gatccggctc 17581
aattgcgcgg catcctgagg taaagagtcg ggtcaaagcg gcatggcaga ccctagcaca 17641
tgatcctgaa tcttcaagca aatccaatag gatcagcccg ctttcgtcgg ccgctttacg 17701
acgtttcgct tgcccgagtc cagtcgatac cggtcagcaa aaaatttgtt cggccttgaa 17761
atgtacgttc gtctaacgta cagttggctt aaacgacatg aaggagccgg tcatgcgagc 17821
aatcaaggac gtcacgattg acatcgatga gccgaacacc gttcgaatga acttccgtac 17881
gaaggagcgc gtgaagagga cgatccagcg tgccgcggca ctttccggcc tcgacgattc 17941
tgcgttcacg atcaacgctg cctaccagtc tgccattgcc acgatcgcgg cgcatgaggc

Figure 3 (Cont.)

18001
gaccttgttg cagacaacgg actaccaggc gtttttcgac gctttggata atccgcccaa 18061
accgaccgat cggctgagag acgcgttcaa gcgttatagc gagaccgtag tctctaagta 18121
atggcaaata ccggcgccgc aaaacgcata atcgagccgc tcgatcccaa ccggcatgat 18181
cgggcggctt ttttttgtgg aatcatccag gtcgacaact tcttcaagaa aacggcgaac 18241
aagctatcga aagcagacaa ccttcgtgtc tatgtgatga ccgaagacga tggcacaacg 18301
gttatagggt tctacgccat caacagccac tcgatcagct atgctgatct gccggaacgc 18361
ttttcccgca cccggccggg acacggctcg ataccggccg cctatatctc catgatcggt 18421
cgcgatcagc gatatagggg tggcggttac ggcggcgatc tgcttaccga ttgcctgcaa 18481
aggatcgccg gaattgctga ccagattggg atcgccgtcg ttcttctcga tgtccttgtt 18541
tgcggtgacg aagaaaagac gagccggcgt gtcgcgcttt acagcgaata tggctttcaa 18601
cctttgccgt caatgccgct tcggatgttc ctgccgatcg cgacgatcag gagcctaatg 18661
ggctaacgcg cattcggtgc gcgatgcacg catttaatta agcgcaaaaa gcaacagaaa 18721
caaaaccgct ctgctgttcc ataagataga ttatgcgatc atttttgta gcggcatttt 18781
agagatgcga catatgagcc agttagagat gcgacggtcg tcgcctcttg ggatgctggt

caaacgtcaa cgtttggaag gaagactggc gacgggaagc gtggttgaga ccatgagcgt 18901
tcggagtcgt catgtcttgt ttgatcacca tgtcgcagaa ggaattgcat cgtcttgaac 18961
tgatccaacg gattcgcggc cgcagcctga ccgtcgtcga ggcggccgcg ttgcttcgtc 19021
tcagccgcag tcaggtgcac cggttgttgc aggcctatga cttggccggc gccgacggtc 19081
tggtctcgaa gaagcgcggc cgtccgagca accggcgtca cagcgaggat ttccgcaacc 19141
tggtgctcga cctggtgcgt gagcattacc tggattttgg accaaccctg gcggccgaga 19201
agctgatcga acgccaccgg attgccgtca gcaaggagac gctgcgccaa tggatgatgg 19261
aagccggcat ctgggtgtcg cgacgcgagc gcaagaagcg ggtcttccag ccgcgcggcc 19321
ggcgcgattg tttcggcgaa ctcgttcaga tcgatggctc gcttcattgg tggttcgaga 19381
accgcggtcc caaatgcgcc ctgctcgtct atatcgacga tgccaccggc aagctcttgc 19441
atctgcggtt cgccggatcg gagaacacct tcgactatct gcacgcgacg aaggcctact 19501
tgcagcaatg gggaaagccg atcgccttct acagcgacaa gcatggcatc ttccgcacca 19561
cccatgcttc caagaaggac agaaccagtg gcctgacgca gttcggccgg gctctttatg 19621
agctcaacat cgacatcatc tgcgccaata ccccgcaggc caaggagcgg acatcacgat 19681
gcaccttgtt ggagtggttg agcgacaatt aatctgggtt gacggccacc atatcgactg

Figure 3 (Cont.)

19741
ccggcgcctt tttcgagtct gacgttgccc ggcggttcgt acaagtatcg atggttgctg 19801
gcgtatcgat gacgcttgag agtgcctttg cgcccgagtt ggtgaacggt cgattcgcat 19861
acgccgagct gctgggctac ttcctcgccg gtgagcatgc cgccctcgcg cagccgttcg 19921
taccggctct tcaaaccata ggtgcggcgc acgagcatga ccttcttcgg cgtgaagggt 19981
tcgccgcgcc agttgcgatg cccgagttcg ttgagacgag cggcgatctg ccggtcgttg 20041
gtggcctcca gcagctcgtt gatcaacgcc acgacctgtg ccggcgtctt gcgtatcacc 20101
gacataggcc gaggtctggc caccgacagg ctctgcgtgc gcccgccgcg ccaacggatg 20161
ttgatgttga cctcatcgtc gacgagcagc gtcacgtctt cgatgagaag gccgagcatg 20221
cgcttgcgtt cgacggcacc ggtgcgctcg tcgttccaga tgcgcgggaa atcggcggtc 20281
agcgccctga tgcgctgctg cgctggctcg tccagcagcg agtggtcggc ctcgttctgg 20341
cgctcgtgct cgcgctggag tgcgtcgagg tcgcgcagcc gtgcgttcca gtcggcttcc 20401
agcgcgtcgg cgaccaggcg gttgtccgga tcgaccttca ggtagcgccg gcgggccagt 20461
tcagcctcat agcgggcgcg ttgcagctgc gtgccgcgca gcgccgcggc ctgctccacg 20521
cgctgggtga tctcctgctg cacggcaagc gcgacatcga tcgctgccgg cgccattacc

Figure 3 (Cont.)

20581
tccagcagta gcgcgctcac cgcctcgtcg accggagcac cgcgcaccca ttggcagtgt 20641
ttgccggcgt gtcgcacgac ggcttcgttg cagacgtaat atgggcgcag ccgcccctcg 20701
aacggctcgt aatggacccg catgcgtgca ccgcagcggc cgcacagcag ccgtccctgc 20761
aacaggccgc tgccctggcg gggcatgcgt ccacgcaggc cgggtgaaaa accggtggcg 20821
ttctgttcca gggctgcctg attgcgttcg tattcggccc aggaaatgta gccgtcgtgg 20881
gcgtcgggaa tcagtacctg ccagtcggat ctcgccacgc gcagttgcac gggcttcagc 20941
ttggcattgt aggcggtgcg cgtgcgtcca taggcgaagg cgccggcata gcgcgggttg 21001
tgcaagatct ggagcacgcg ggaatggtcg atctcgttcc acaggacgtc gcccttgccg 21061
atgccgcgac ggatacgccg cggaaagagg atcttctcgc cccgcaggcg gcgcacgacg 21121
gcgcaggccg agccggtctg gcggaaagta tcgaacagga gccgcaccgt gtcctggatc 21181
tgtcggtcgg gatcgagcac gacccgcgcg tcaggggtgt agaccaaccc gatcggcagc 21241
ggcatctcga gttcgccgcg gcgcgccttg ttgagaatgc cgccttgcag ccgcgacttc 21301
aggatgtgca gttcggcctc gctcatcgtg cccttcaggc cgagcagcat gcggtcgttg 21361
aaataggccg gatcatagac gccgtcctcg tccatgatga gcgtgcgcga caaggcggcc

agctcaagga gacggtgcca gtcggcattg ttgcgtgcca ggcgcgacac ttccagcccc 21481
agcacgatcc ctgcatgtcc catcgccact tcgctcacca ggtgctggaa gccgtcgcgg 21541
tcctgcgact gcgcgccgga gaggccgagg tcgctatcga tgacgtggac acgttcgatc 21601
ggccagccca gcgccacggc gcgatcgcgc agggcgtatt gccgcttggt gctctcggtg 21661
ttctcgaaca cctgacgaag cgaggactga cgcacgtaga ggaatgcatc acgccgcaga 21721
tggtcggcgt caacctttat ggcgatgtca gtagacatgg ttccctcggg tctctgctgc 21781
cagcaccatg ttggcgagca tgtgcacgag ctggcgatcg tgcactgcga ccgaagccgt 21841
aggccgtgat tccagccgcc gatgcgtcgg cgggggaggc tgcgcgatca gcaccgccag 21901
cccttgccaa aggccgtgga aaacgatggc gcccatgtcc ttggcgcagg cctgaccgca 21961
aaggacggcg gtgcgcagcg tctcgtagaa atccttgcag ctgcgcggta gcaccggggt 22021
gcgtgcatgg ggctcaccgt ttttttttac gggcgatcgc gcgttcgatg ctgcggggat 22081
ggacactgat gccgagcgtc gaatgcagca gttctgccag ggagcgcgcc tgcagcgggg 22141
cgcccgcatg ctggttctgc tcgatgagct gcatgacctc gtcggtgagt ttgtgggccg 22201
actttggccc tcgggtgcgc ggcagcaggc cggcaatgcc gtcgcgttcg aacgcggcct 22261
cggcctgata gtaggttggc cgcgacagac cgaaaagcgc ggcggcatcg gccttgttga

Figure 3 (Cont.)

22321
cgccatcctc ctggacgtga cgcagcatct cgtacttcac ctgcacgaga tcgagaggat 22381
cgaagaaggt ggactcacga aaccagggtg cacggacggc ttcgggccgc gcattgagtg 22441
ctccgagctc gcgcagtcgc tcacgtttgg tctcgttggg catggcataa cctcttccta 22501
gtggtgtaaa tcaaattacg cctcgataga gaacgtgtca acctaacgac gccgggcgat 22561
atggctgttt atgctgcata taactacaat gtagaggcaa ttatcgctgt gagcgcccgt 22621
atgattcggc ataattagat ttacataatc ggcataaatt gcctgacacg cattcagccg 22681
ccatggctgc gctcgatttg ctcgatcaat gcggctaggg ttgccagatc atctggacgc 22741
acgaacgacc taccggccgc gatctgaatg aaaacatcgg gtgcagcgac gtccgtccat 22801
gacgcaagca gcgagcgaag ccgcccatcc gcgtcgtaga acatgacgcg atcctcgccc 22861
cagttctgct tgcgtgtcga caacacgaag cgctggccgc gccacggatg gaacgggtgc 22921
gtgacctcga actctatacg cacttgagtg tcagtacgaa ctgcagtcct ggacttgaaa 22981
gaaggggcgc gtcgagcgcg ccaaccagac gctgcaggat cggcttgtca aggaactgcg 23041
gctgcgcggc atcgacacga tcgcggcggc caatgcctat gcgccggaat tcatggccga 23101
cttcaatcgt cggtttggca aggcgccgcg caatccgaag gacatgcatc ggccgtttgc

Figure 3 (Cont.)

23161
cgcgcatgag aacctcgatg gcgccatgtg ccgcaaggag atccgcaagc tgtcgcagtc 23221
gctgacgctg cgctatgaca aggtgatgtt catcctcgat ccgaccgacc tcgccacggc 23281
gctcgccggc aagaaggtca ttgtctgcga ctatcccgac ggtcgcctcg aggtcaccca 23341
tgaggggacg tccctgccct acaggacctt cgacacgctg cgctcggtgc accgctgcga 23401
ggtggttgag aacaagcgcc ttgatgacat gctggcgctg gtcgccgaga tgcaggccgg 23461
acgagagcaa cagcgcagca agggcgggcc gcgccgcacc ggccagacgg accatatgtt 23521
cggcattcgc gacggcagcc agagcaatgg ctatcaaaag cgcggcacca agcctggccg 23581
gaagacggat tttaccaagg atccggtggt catcgccaag cggcagcaag cccttgcgca 23641
gctgaaagcg gcggagtgat cggggtgtca aagctgaagt ttatcttgcg gctggagcca 23701
tccgccgccg accggcctgc gcaaccctga ccagctccac ccggccggcg gctcgcgtct 23761
gcgtactttg taaatatatc aacttgcaaa cgcagtacta aggaatagga tgatgtcgcg 23821
tttctaagtt gattactttg tctcatcttt aaatagctgt gacatttttt gtagccgcaa 23881
agttaaagtg tcctgttcct gcaaagtaag aatgtcactc tccccgcgtt ttgatggcgt 23941
gggagattgc ggatgggatt gattgcgatg agcgagcgcg acctgcagcg gattgaggtt

ttgtcgaagg tgatcgacgg ccgcatgacg atggtgtcgg cggcgcatgt cctgggctta 24061
agcacgcgcc aggtgcgtcg gctgctggat cggatcagcg ctggcggtgc ggcgtcgatc 24121
cgccacaagg cgatcggtcg cccatcgaac aatcggattt gcgacggcgt gcgcgattat 24181
gccatggcga tcgtgcgcga gcgctatgcg gatttcggtc cgacgctggc ggctgagaag 24241
ctagcggagc ttgatggcct gacggtgtcg cgcgagacct tgcgccaatg gatggcggac 24301
gccggtctgt ggctgtcgcg caagcagcgg cggacgtttc atcagccgcg gttgcggcgc 24361
gaggcctatg gcgaactggt gcagatcgac ggttccgagc atcgctggtt cgaggatcgc 24421
ggtgacccct gttcattgct ggtgttcatc gatgacgcga ccggcaagct gatgcagttg 24481
cgcttcgtac gatcggaaag cgcgtttacg tatttcgagg cgctggagct ctatctgaag 24541
gcgcatggtg ctccggtcgc cttctattcc gacaagcatt cggtgttccg ggtggcgaag 24601
aaggacgcca agggcggcca gggcatgacc cagttcgggc gtgcactttg cgagttaaac 24661
atcgagattc tttgcgcaaa ctcgagccaa gccaagggcc gagtcgagcg gatgaaccgg 24721
acgctacagg accggttgat caaggatctg cgcctggagg gcatctgcgg catggacgac 24781
ggcaacgctt tcctgcctcg gttcatggag cgctataacc ggcaattcgc cattacccct 24841
gcccggtctg atgatctgca tcggccgctg aaccttgccc cggatcggct gcgcgacgtc

Figure 3 (Cont.)

24901
ctgtgcaaac gtgagcagcg ttatgtcggt gcgcagctga cgttttcgtt cgagcgccag 24961
cggatcatgc tcgaggagaa cgaagtgacg cgcggactgg tcggtcgcta tgtcgagacc 25021
catgcctatg ccgacggccg gctcgatgtg cgctggaagg ggcattccct gccctaccgg 25081
gtgttcgaca aggaccagcg ggtgacgcat gcggcgatca tcgagaacaa gcggctttcc 25141
gatgtgctgg cctacatcaa ggagcgccag gacgagcggc cggcgccgaa ggtcaggacc 25201
aacagcgaga agaacggcta cacgccgcgc ggtcgcaagc cgggcaagcg gacggatttc 25261
atgaacgatc ccgtggtcat cgcccggcgg cggcaggcgc tctccaatct tgatgccgcg 25321
gaatgatcca ttgatctggc tgtcaaggct aaagccgata ggtgcccctc acccgccccg 25381
atctcacctt gcaacccgga ccagccggtc agatcggggc tggtcgtcgc gccgggccgc 25441
agctcaaagt gatatttcta ctttgcgcca cagcggacag ttcaacctgg ccgccacatt 25501
ttttgagtga tttgagtgta gcacagaagg cgaacatccc ccactacgcc tgagccggag 25561
ccttttcgtg tgcggctccc cccgatccac acccatcatt caccgtttcc ggtcgcggct 25621
ctcaagtgcc ggtcgtaaag gcatccacgg ccggctttcg taatcgccca ctcgaaatca 25681
gtcaggtgga agcgacggcg ggtcacgcaa agccggcaag ccaaggccta attgaatcat

Figure 3 (Cont.)

25741
tatccgcccg ccgacaaaac tcccgtagtc tgcgacctaa tctgaaatgg tcgtctccga 25801
gctcgtcggg gggttcgcaa agcttcaacg atacaataca atactaccat cgattgtgag 25861
gcggttatct tggcgagaga gttgttattc ttggcgtgcg caattgtgat tgccgacagc 25921
tggccggcga aggcgatcga catagaaagc ctgttcggac acaccatccg cattgagggc 25981
gagtaccctg aacgcacctt gaaagtcgat gatcgcgaat tgcaccgcaa cgcccttctc 26041
ctcttcgacg gcctgttcat tgtggacggc gttccagcac tgatcggcag cagctcgaat 26101
gggggcaacg cctgcgacgg cacccctttc gtcgtttcgt ttccacctgg tgccaggccc 26161
cgtttcgatg gaccgatcga agcctgtgct tacatcgggc acgaggtctc cgacgagaga 26221
atcctattct ccaccaataa cattccggga cagggccgag agcaatgggc ttggacgcct 26281
gccgacggaa tgaaggaatt aggcgtcgca gcatttgtcc ccgacgacaa atcgggttgg 26341
caggcgctca gggaacgctc gtttgagcat ccttccgacg cccttaagaa cgcggatatc 26401
gcggcaacaa tcaagtcgct gctcggagct gatttcgaag cctttcaggc aatcatcacc 26461
ggaacgggca gcggcgaatt taagagcgac gactatattg gtagaacgtg cacgccccac 26521
atgtgcagag aacaggaagc gttgctcttc ctgtctgcca aggatcgtcg cgcctatgcc

gcttggaagc cgcaccaaaa gaaaatcatt gttcacccac ctgtgaagca gtggcccgag 26641
aaagcaaaac aggaattgag agcatgggca gaaacgtgga agtaacagcg ctagcggggc 26701
tgatctccat acaatagtgc cccagaaacc ggtgacttac ttaaatagtc cctaaagccc 26761
accagatgcg ccaggttgtt tctggggcga atagtcaata atgcagtagt catcgccgat 26821
ttgcaaaaaa atgacgacat tctgattggc gctatcccac cacttatcaa ttgatgtcac 26881
tggcgttctt gaactctttg gcgggccata ggtgtttgaa agtttgcccg tcagcgaggg 26941
gcaatcttgt ccggacaaca atttcaatct cacgagcgca agacccgagt ttcggccaaa 27001
aacgaatgcg gccttgaatt tgaattggcc ggcagagtac ttcccgtcaa gcaagtgctg 27061
cagccgcctg tccccttta accgttccgg tttttttggc ttggtgattg aggcgtcatc 27121
aggcgcattt tgacgacttc ctttggcgtc atgccccatc tggtatactg ccaatccgcc 27181
catgcatgtg tgccagccgt agccatcaac atgagcatac ctaaaccgcc tgcatggacc 27241
accttcattt cttgcccccc agagcgcaaa cagacacttt tcattggcaa ggagtaagct 27301
tggccgactc cgcattcttc ggaccatagc gagcaggacc acgcctactg agcttaagta 27361
tgcagggaga gtcgttcata ggcgattttc tcattcgcag gccactccgt cgccatccct 27421
gtcgagcttg cgacggtagc cgggctcgcc agcgtaaata ggcgctgcac cagcagcgcg

Figure 3 (Cont.)

```
27481
tgccgcggcg cagttttgaa agtagacctc gccaccttcg ggcgtggaat taccgtcatc

27541
gttcgtctga gccattgccg gcagattgcc aacaaggatc gcgaagaggg cgacggccgt

27601
ggtaagcaaa cactctttca ttcggtttct cctggtaccg agcggcgcgc aaaggtcggg

27661
gtgacaagtc tttgcgttgt ccggtacagg attatacaaa ctgcaactgc gcgtatattc

27721
ggccagatgg cttagcccgc tagggtaggc cttacgggcg tcaaccgagg tgacgagctg

27781
gggcagttgg tcactgagcc tcagaccgag cagccctcac tgcgaggcgt tgatcgcgcg

27841
acgggtatat ttttcgtcac tgcgtgagtc cgggccgccg gaactccgct cgcgcggtgt

27901
gccggccttg gccaaagccg agactacaca attggaatcg aaccgcggac gccatgctgc

27961
gcgtttctgg atttaccccg cactcaatgc ttaaagcagt tttcccggtg ccagcggagg

28021
aagtgcggat gtggcctttc gaatagtcgc tgcggaacga tcgcgcgtcc cgttcggttg

28081
atgactggat gctctccggg tcgttcccct gccgcgaaac aaggatgttt agctcgtcgg

28141
aaaggctgga tcaaaccccg atcgaacatc cagtgggcgg tcccggaaag cgcaatgcca

28201
ttgctcagga tgtcgggacc gttggcttag accaagcgaa tatgcgcagc atcgacttca

28261
gcacgaccgc cgccgttaat cagctttagt ccggtgatcg cgcatcgctt gtcgtatgct
```

Figure 3 (Cont.)

28321
ttgaggacaa ggcgacggaa aagacgattg cgaacgattc gagacgtgag ctgagcgaca 28381
cgatcacgct cctgctcaaa aacgaaggat gactgcagtt gctcgcccat tccgggtgcc 28441
aaatcgacga tttctggctc gccgacctgc ccgtgcgttt acgatcgaag cgcgaaatgg 28501
tggagagggg gcatgcacta tcgctcgcaa aggaggtcgg tgctgttcac ggcacccgga 28561
cttatcgtcg gtgcgctcgc gataggcgct gcgggcggca tcagcgtaag tccgggcgac 28621
attcttgcgc tcgtggaaaa gcctcacctg ctggtcgccg ttctgttcgt cggcgccttc 28681
actggcatca tggttgagca ggctctgtca aggatgcgaa ggcaggatgg cgcgcgagga 28741
accgctcgcg ctgggagaaa cagcgctcgg cgacgaatgc cgtcgtaggg ccatgggctc 28801
ccacaagcgt tccggaatca ccgaaacgac ccgacgctac cgaacagctc cggattgtta 28861
tgaactccac cttcacgagt cagccgctcc tcaacaggag cgaaccgcgg gtattcaagg 28921
aattctatcg cctggtgatt ggctgcaatc cggcttggca ggtgatggcc caagtctcgt 28981
taggcgaaat cctccgcagc aaagacgcgg acgcgtacag ctgcataaac gccaagcggg 29041
tcgacctcct gctggtggac ggcaactgcc gccctcgcca tgtcgtcgaa tatcagcgcg 29101
gagcgcacca tcagggtgcc gcagccgcgc gcgacgcggt taagaaggcg gcgctcaggt

gcgcagggat cggctattac gaagtcgttg ccggccagac cactccgtct gacctcagac 29221
gattggtcga gaagctcgtg gagaagccgg aacttccaat atgcgctccg gactgacggg 29281
gggctcggcc gcggctgttg gcgctcagaa gcgctctgcc cctcgacaca actcagacgc 29341
cgcagcgggc gaatagtccg cacgcccctg accacattgc atactggttg gatgctctct 29401
tcaaggttgg ggcttttcaa tatgttcaga ctacttgcgg cgatactcgt tttcacggga 29461
ctagcttcgg cggtgaatgc cgatcttctg cagactgggg gtagccgatg ggttgtgctc 29521
gcaagtacgc gagatctcga caacgccatt ggcatcgcga acctttacca gcatcgcttt 29581
gatgacgttc gcgtggcgga ggcctcgaac ggttggctcg cagtgatcgc aggaccagta 29641
tcaatcgccc gaggagcgaa ggcggcacgc gaagaattgt ggagtgctgg cgggtttccc 29701
cctgacttgt tccttagcaa tgggcaaagc ttgagacgca ccgtgtggga gccgccgaaa 29761
ggtcggccca ttcccacctg gtcgtataaa ggtggccagc cactagtctt ttcagctgga 29821
gggctcgaga ttgaagtgtc tcatcttgcc gagggcaata ctcggtatcc gtctatcacg 29881
cttcgcaggg ccggacgtct gctcataaag gaagttctga aggggtccga gtctttcggg 29941
gacaacatga atgctgaagt gcggctcgtt tggctcgacc gcgcggtcgc cgaaccacag 30001
atcatctttt catctcattg gaatggagca cattgctgca cagtttctaa aatactaaca

Figure 3 (Cont.)

30061
aaggtcggca acggctggac aagtatcgaa ggcgctacgc tcgatggcgg tgggtatcga 30121
cttcaggaca tcgacggcga tggcagcgtg gaattgctca gcgtcgacaa ttccttcctt 30181
tacacgtttg ctccttacgt cttctcatca gctccgttgg taatatcgaa actcgatgga 30241
gatcgtttga ttgacatgcg ctggaattct gccttccgac gctactatcg tcgcgagctc 30301
tttggatggg agtaccgggc aaaactggaa ccagagatct ggcgaaagaa cggttttctg 30361
agcgcttggc tggcattgaa atcagtgttg ggcgaatcag accaagcctg gaccgtggtc 30421
ttggaaaatt acgatcgttc aagcgaatgg cccttgaccg tatgtgatgc tcctctgaag 30481
gaaggtgtgt gcccagagga agccactcgc gaggtgagtt tcccggaggc gctgcgcgat 30541
caccttgcgc gtaatggata cttgggtccg caagtggcga aaatcgagga aacttcaaag 30601
cccactgagc agccgtcacc cgccgatagc acatcaacgc ctgcggcacc tgagaagggc 30661
gccgcctcca gtgcaggaac aggcttcttc atctcaaaac aaggccacct tgtcaccaat 30721
caccatgtga tcaagggttg cagcgccatc gaagtgcgcc gccccggcca gttgaggctt 30781
ccggcaaata ttgtggcagt ggaccccacc aatgatctag ctctactacg tgtggaaagc 30841
gatacgggcg catacgcatc tgtccgggta gaaacacggc tgggcgagtc agtcgccgta

Figure 3 (Cont.)

30901
tttggctatc cgctttctca tgtcttggcc agcggaggca acttcaccct cggcaatgtt 30961
acggcgctgg ctggccttgg caacgatacg cgtttcatcc agatatctgc tcccgtccaa 31021
ccgggtaata gtggcggccc gctaattgat agttatggca atgtcatcgg cgttgtgacg 31081
tcgaagctcg acgcactggc tgcacttgcg gtaacagggg acatccccca gaatgtaaat 31141
ttcgccctac gcggagcaag cctgtatgct ttcttgctct cctacgggat ctcgcccgtg 31201
gctgggtcga atacacaaaa actggacgcg ccggaactcg ctgaacgtgc ttcgtcattc 31261
agtgtggcag tcacctgtga atgacttggc accggtccgc tgcgaacgtg ttacgtgcag 31321
ctctctcgca catggccact accactgcaa cgtgcaagtc ggagcatacc tcgagctcga 31381
gctcttgatg ggagtagaac ctgagacttc gtcaattcga cgtctggcgc agttgaatgg 31441
atccgaaccg gcggcaccaa gctgtaaaaa cttaagtcat tccgtgctcg agatttttc 31501
caaaaattgg cttacgcgag atcttacatc gttacctccc accacagtga tcgtcgcaac 31561
gccctcacgc tggcgaagtt gacgaacctg acgagatagc ccatattttc gttggaggtg 31621
ccctatggcc atgaccgaga aaaaaggtgg ttcccgcaag cgcaacgagc gccgtaagaa 31681
ccttatcacc ggatatgccg gcaaatggga accgctcttt gagaaaaaag cggcggcccg

cgcgaccgca gcgcgcgtgc tttctggcgt atccgaaggt gtcaagcgcg ccaagaacac 31801
gggcggcacc gttcgtgtga cctatgtcat tcgatcggcg gacgaagagc cggaaatcga 31861
gatcgaagag atcgcccctc agaaggacgc gctggacacc gccctcgcgg ccgcaaagca 31921
gcgcggcgcc gagcgtgtcg ccgagatcct caagggaccc gagatgttgt ctgcggacga 31981
gttcgccgaa gagatcggcg ccacgcgcga gacggtgaac agaaagcgta agcgtcacga 32041
aattctcggg ctcgaaggag caaagcgagg cgtgcgcttt ccgaaatggc aaatcggcga 32101
tgatggtcaa ctgcttggcg gtctcgcgca actgttcgaa gctttgaacg ggcacccttg 32161
ggcggtttac cggtttcttc ttcaggaaag cgatagcctc ggcggtcgca caggtcttga 32221
gatgctgcgg aagggcatga tcgagcatgc agttggagca gcgcgctcca tcggcagagg 32281
tgatttctcc tgagcatctc gctgaatttg ctgccgccgg ccgacttcgg ctcgcgtgag 32341
cttgtgaccc aaaaattgac ttcgaacgcc ccgtggtacc ggctctacca aagccggtat 32401
cccaaccctc ttggctacgg cttcggatca agccgcttca gtgatcccga agtgaccctg 32461
tctgcgggtt tcggcaaagt ccggacagga tttccggtaa tctccggaca cagttttcag 32521
taattcccgg acagcgattc cgctaaatcc cggacagttt ccggcggcgg tttgacgggt 32581
tggttcgcgg ctgcgccgtc ttgttggtta ggcctctcac gacaacgttg agaggggccg

Figure 3 (Cont.)

32641
atgccgagac ggaagcaagc aagacgaacg acagtgaggg atatccggac tattctgcgc 32701
ctgacccatg aagagggtct ttcggtgcgc gagattgccg agcggctgaa gatcggcaag 32761
agctcggtat cgacctattt gctgcgatct cgggaagccg ggctttcgtg gccgttgcca 32821
atcggcgcgg acgaggatgc aaagctggag cggcggctgt tcggccgagc cggtcgaccg 32881
ccgcgcgatc tcagcgagcc ggactgggcg ctggtggttc gggagctgaa gcgcaaaggc 32941
gtgacgctga cgcttctatg gcaggaatac cgcgccagcc atcctgatgg ttacggcttc 33001
acctggttct gcgagcaggt tgccgccttt cggcagcgca ccagtgtagc gttccgcaat 33061
cggcacgcgg cgggcgccgt gatgcagacc gactatgccg ggccgacggt gccggtgatc 33121
gatccggcaa ccggtgtcat ccatccggcc caaatctttg tcgcggtgct gggcgcctcc 33181
aacctgacct tcgcccatgc cagctttagc cagcagttgc cggattggat cgacggtcag 33241
gtgcgtgctc tgaccttcta tggtggggtc accaaggcaa tcgtgtgcga caacctcaaa 33301
tcgggggtgg ccaaggccct ttggttcgag ccgacattga ctgcgacgtt cgccgccatg 33361
gcggagcatt acgacaccac gatcctgccg acccgcagca ggaaaccgcg cgacaaaggc 33421
cgggtcgaag gcgcggtatt gatcgtggaa cgctggattc tggcccggct caggaaccgt

Figure 3 (Cont.)

```
33481
accttcttct cgcttgccgc cctcaacacg gcgattgccg aattgctcga ggacctgaac

33541
aaccggacga tgcgccatgt cggcaaaagc cgccgcgagc tgttcgagga gatcgagcgg

33601
ccagccttga agcccttgcc ggcgataccg ttcgaatatg cggaatggaa gtcggcgaag

33661
gtccatccgg actatcatgt cgaggtcgac aagaccttct actcggtgcc gcatcggctg

33721
atcggatgca ccctccaggt gcggctcacc caccgggtgg tcgagatctt ccacgaccac

33781
cagcgtgtcg ccagccatgt tcgccgctcc cagcgttccg gccacgtcac cgtcaacgac

33841
catatgccca aggcgcatca gcgctatgcc aacaccacgc cggccaatct gatcggccgt

33901
gcgacccaga tcggccccaa tgccgccatc ctggtcgaac gcatgatgcg cgacaggccg

33961
catccggaac agggataccg ctcggccatg ggcattctgt cgctggcgcc gcgctatgga

34021
tcccagcgcc tcgaggcggc ctgtgagcgg gcgctcacca ttaatgccat cacctattcc

34081
tccgtcgcct ccatcctcaa atccggcctc gaccgggaaa gaccgcaggc tgaacacgcg

34141
gcccccacgc ctgcgcatac caatatccgt ggccgatcct actaccagtg aaggaagcaa

34201
gaatgctgac gaaccccacc ctcgaccaga tgcaggccct cgggctgacg ggcatggccg

34261
ccgcctggcg cgaattgacc gagcagtccg gcaccaatga gctcagccgc gatgagtggc

34321
```

tcggactgat gctcgaccgc gaagtcaccc tgcgcgccga caagcgcatc cgtaaccggc 34381
tcgcctccgc caagctacgc tttgcccagg cctgtatcga agatatcgac ttcgccgccg 34441
cccgcggtct cgaccggcgc aacaccatgg cgctcgccca ggggcaatgg ctcaccgccc 34501
acgagggcct gatcatcacc ggccacaccg gcaccggcaa gtcatggctg gcctgtgcct 34561
tcggcaggca agcggccagg ctcggtcact ccgtgctcta tgtgcgcgtg ccccgaatgt 34621
tcgaggagct cgcgcttgcc cgcctcgacg gctccttccc ccgcctcatc gacaggctca 34681
cccgcgtcca gctcctcatc ctcgatgact ttggaaccca tacgctctcc gatcagcagc 34741
gctttcacct cttcgaaatc gtcgaggagc gttatcagcg aaagtccacc ctgatcacag 34801
ctcaggttcc cgtggcaagc tggcacgacc ttattgccga cagcacggtc gccgacgcca 34861
tactcgaccg tatcgtccac aatgctcacc gcatcaccct ccggggcgag agcatgcgaa 34921
agcaaaaaag cgcacccctc ttgactgggg cagaaaacgg cgaaatcaat cagccctgat 34981
gctaaccagg ctgccgagga ccaaccgcat caaactgtcc ggactttaat gaaattgctg 35041
tccgggattt agcggaatca atgtccagtt tttgcgaagc gcgcaattgc cggcagcatc 35101
gccgttcccc aagatctagg cacggccgat ttgtgggggc atggaacacg cgttgccggc 35161
attgccgcct tcggcgatct gcgggcacaa ttggcgactg gagaactacg tcgaggttcc

Figure 3 (Cont.)

35221
aggatctgtg cggccaaggt cacaaacgat acaggcggct ttgacgaccg gcgcctcgtg 35281
ccttcacaaa tgcgcgaagc aatcactcgg cttaacgaag aattcggttg caggattttt 35341
gtcatctcgc tcggcgacaa gaagcgcgtt ttcgacggtg gcaaggtcgg gacttgggcc 35401
gcgacgctcg acgaactcgc gcgagagcgc aatgttgtca ttatcgtgtc cgctggaaac 35461
cgcgggccac gcgccggtag ccgcgtggag caaggcgtca ccgagtatcc ggactacctc 35521
ctcgaggcaa ataatcgcct gcttgagcct gccggcgcca tgaatgtaat cacggtcggt 35581
tcgattgcgc agggagacgg tctcgacgcc gatatggcgg gcgatgtgcg ggtccgcccg 35641
ataacccgcg cgaacgaacc ttctccgttt tcgcgcgtgg ggccaggtct cggtggtggc 35701
accaaacccg atcttgtcga cgttggtggc acgttgatct tcgaccctgt cgtcgcccgc 35761
cttcgaggcg gcgaggatcg gccgagcgct ggggttctca ccctcaacca caactatctc 35821
aaccgtcttt tcacggctgg gtccggcaca tcctactcgg cgccacgcgt cgggttcagc 35881
gccggtcaaa ttctcgctcg ctttcctggc gcttcagcga acttggttcg tgcacttttg 35941
atcaattctg cagaggtccc gcagcaggca agcgagcgcc ttcagatact gggaagcgag 36001
gcggtgcgtt cggtttgcgg ccacggtctc atcgaccttg agcgcgccgg tttttctgat

Figure 3 (Cont.)

36061
gatgcccgtg tgacattgta tacggaagac gagcttccgc tcgatcattt cgctgtctat 36121
cgcatcccaa tccctgaggt ctttcaggaa ggaaacaccg agcgcacaat tcgcgtaacg 36181
ctcgcctatg accctcccgt ccgccatacc cggaacgact atgctggcgt cgggatgagc 36241
tttcggctgg tgcgcgggtg cgagcctaat ttcatcttcg agcactatcg caagagagcg 36301
gaggttgaag gccccttccc cgaaatggag aaccgcttta actgcaaact cgagcctgga 36361
ccgaaggtaa gagagaagag ctcagtgcaa cgcgccagca tcacgttcaa gcgcggaatc 36421
gagcaatacg gcgacagcta ctacctcgtc gtgcgctgcg agagtggttg ggcgacccat 36481
gtggatcggc aaccgtttgc ggttgtcgta gagctgcttc agaaggctga agtccggtta 36541
tacgaacgcc tgcgtcagcg cgttcgggca taacagaaca tctgaaccag tagactccta 36601
tgcggccctc tcaccagtca tgcccaacgg agtatggaac gtcaaatgtc tcaatctata 36661
caaattaacc gctctgccgc tgacgcatgg tcgcagctgg tcaaaggcgg agccctcgac 36721
attgatggcc gcgacaaaga gttcgccggg gcgatctgca agatgctgga cccgacggga 36781
actgatctcg gggacgcgct cgcgaaagcg acgacagatc agctaatcca ggtgttcttt 36841
cgtgccctcc agcctttctc agaaatgtac cgtgaaatcc tacggttttt cacaacagcc

ggcgcaaaat acgggcggga ccaatggcgg attgggatta gcgaaaagca cttcgagctg 36961
tctgactttg aagatttcgt gcggatgtgg gacggcgttc ccggtgaaat cgatgttccg 37021
gcattgggac atgaagactt tggcattgtt tggcttgcct gggaagcgta tccgcaacta 37081
ggaaacgtcg ccaataaggc ggcgcgagaa cctgccgagc tcggaattgc cgacgtcgat 37141
cggtggctcg tcgactaccg atcgggccaa atcaaccccc tcccactatc ggtgctatca 37201
gaacaacagg acgcaggttt ccgagaattg gccgcactgg tcgccacagt tcatgaggga 37261
ttggtggcgt ttagtcagaa ccgagctgtg ttgcggtcgc aattcgattg gcgaacgttg 37321
aagggcagtg atgctttttc agtcaaccaa cttgccttcc tcgatacgga caactggctg 37381
gggacagctg tcgcaggcct ggcgctggca aaggggatcg cccctgaaag cagaagcaga 37441
atcgcccgcg ttctccaaaa tgcgttcgag ggtctgccaa ctcgcaagct gaaagcgaga 37501
gtctccttga acgatctcga ccggtttttg tcattgccgg tttggcagaa gcgccacgag 37561
atctatgcgg tctgggtatt cacagaatta gctgcggccg cgaatgagca cgacctggag 37621
atatatcacg accaaggtag gatcgccttc gagttccggg agtctcgact tgccactgtc 37681
acgtcggcac ggccaccaat cgatatgata acggagcgtc gctctccaat tgcaaatcca 37741
gtcggcgctg gtcgaaccgc caatgtccag ccagatttcg gactttgggc acgcgatccg

Figure 3 (Cont.)

37801
ggggccgagc gctgcgctct ggtggtcgag gtgaagcact ataaacgcac cgcgaagaag 37861
tcgttttcgg aagtcatgac cgactatgcg gctgctcatc cgaatgcgcc gatcgttctg 37921
gtcaactacg gtccgatcgg cgacattctg gactgcatcc cgctcagcgc gaaggctcgt 37981
tgcgccaccg tcgagcacct gactgccctc aaccggacag ccagggagga atttcgagac 38041
ttggttcgaa aggtgattgg atggccagtg cgggcggcgc ccgagatcgg agggacaacc 38101
cgggcgaaaa gtgctgtcgc ggtcgatgtc tcgcgttcca tggctccagt cctgagcgat 38161
cctcgattca gctccgcgct ggccgcgatt gcggtggcgc cgcacgcctc tgaaatcttt 38221
cccatcgatc gacgtgtcca caccgcaatt tcggtcgagc aggcgatcga gcggctgcgt 38281
agcatccaag gcgacataaa cgcgttggaa gctccggtta ctgagctgct tgggacttat 38341
gacgaagtga tcgttttgac ggatcgggat gggcttaacg atttgagcgc attaagatcg 38401
gcaagtgagg aatttgccgc aggtagcttt ttccgggtga ctgtcagcag gcctgagtcg 38461
acgtgatcgg ccgaggctcg ccgccaaccg attagactac ccatcacagc attgcccccg 38521
gcagaaatgc cgggggcaat gtttgaattc ttcccgtcgg gagccgaaag atggctcaat 38581
gactgactgc taaaagccgc agcttatgca tcctgcgatc aacggccaga gccgggttag

Figure 3 (Cont.)

38641
ccgcagcgac agcatccaaa atggcggcga tatccgatgt gcggcccttg cacggcggcc 38701
cgcatgcggc ccacaccagc ctgagggcgg cgaccgggaa gcgcgtggcg agctcggcat 38761
tgttacgttc gagatcgtga aggctgagcc agtcatcctc gaatgtcgag acatatggta 38821
gaagggcttc gaccgcagct tcaaacgcag tgccggccgc cgttgctaac gaaaatactt 38881
ccttgctcac gtcatttgaa agatagctgc ggtcgcgcgg ccagatcgcc tggaatgttg 38941
ggccatatag gtcagtccag gcggccgctc gctcgtcgtc cggattttcc tcaagccagt 39001
ttgtcataat tttcaaggca ccgacgcgta tgtccgcggc agcctcccga agcgtctgcc 39061
gcgcctgctg cggcgagata cccctgacca cattcggttc gtcaaaagac gcaaccaccg 39121
ctcggacgag atgcgaggct gcattggcgg ccgagacatc tttttgccgg ctctcccgaa 39181
ctccctgtag aatgagatcg gcaaagctga tttcagtatc cgcaacgaag ctgttgtatt 39241
cgaccaagac cccgcgtagt cgcctcccct catcattgtc cgcagcgatg aagggtctca 39301
agtggtcgag agcaatttcg ttcgaaacgc tgaaaacgaa tgacaggtac cggacgcacg 39361
ctgcacgtgc catttcgccg gaataggtca tggacacgat catccgctgc aatcgttgaa 39421
agtccgcggc gttcacgtcg tctccatttt ccctttgaga gctgatagct tgaagcagtg

cttccgcaag tgatccacca gtcgagttga tgacccggtc ataggtctcg acatcatccc 39541
cccaatcaac gtcgggctcg ccctcagcag cttgccacag ccgatcccac cagttcgcgg 39601
gaagagcgag ttgaagctgc cgtgagtgtt ctgctatgcg agccagggga ccgacaagag 39661
cgatgacgat ctcgtcatct gcctctccga gaagctcgac cgcttcttga atgacacgca 39721
gccactctgg gcttgtcata ttcgcacgac tgggaatgat ctctagccac gtcgcccaac 39781
gtgcaactac gccgatttca aggggatgag aacgcagcgc agcataggct ccgaccggat 39841
cctctcgaca atattccacc cagccctctc gatcttcgat gtcgctgctt tcctcgagcc 39901
gatcggcgat cgtgaggcgt tcgcttggtt gagccgacac aatttgcgcg gtgcgcccgc 39961
ggacggccct gactccggag ctccaagtgc ggaaaagatc ccgctcatcg atttcacgcg 40021
acaggtatgt gcgccgctca cgaatttcgt gtagcagggt ttcggcctcc tgcgggagaa 40081
ctacgtgctc actgatcgcg gtcaatcgaa cccaaatatc gcggtcacgt gcacggtcct 40141
gccagtcgat accgtcagcg ttctgttccc ggtcggcata tctttgtgga ccctcgacaa 40201
ggaggcgccg aactagacgt tcgaccgcct ctccgcttgc ctgagcaatg cgagcgcgaa 40261
caatggcgac gaactccagc gcgaaggacc agaaggccgc ctcgttgctg gttgccagcg 40321
cctcaatagc ctcgtcggcg gtgaaaagag cttgatgtgt aagtgcgtgc atccaaagcc

Figure 3 (Cont.)

```
40381
gggtggtcag gttgaacggc tccgcccgcc atccgccgac cacccttttc gtcccctcca

40441
aattggcttg agcggccatg ggcaacgcgg atgtgataaa tacggtgagc ggaacaaacc

40501
cgcggcgatg ctgattttgc tgatgattaa caacggacgg tacaccgaaa tctgtaacat

40561
cgcgtacctg cccgatcagt tcagcatcgc gcgcagtccg gagctggcaa gaaagtcgct

40621
gcgaaccccg ctcgagcagc cgcaggatgt tttccgcgtt gccggcgggg gacgccaaaa

40681
catcccgcaa gaactcctga tgctcgctct ccatcgaaaa acgagcaata tccgagagct

40741
ggtttgggtg ctcagaagga tcctcatcgc gaaacggcgc ctcgattgtc aggcgcggtc

40801
cgatggcatt gaccaagtgt ccgaggtcgg actccacgac cggccctcgg ttcagccggt

40861
gacgcagctg atagtctcgc aaactgtcgt gtgatgccgc cgcggccgct tcggcgagca

40921
agcgccaggc tttctcccat atcgcatcct gcggacggtt ctgatcgagt tcgcgaaaca

40981
cggcatcgga gaactcctgt gatcccctcc ccagatgttt aatggcggtt aggtatctga

41041
ccttgtcatc ccatcctctt gcgaaccatc gggcaagcat ccaggctcgc gcgcgttcgc

41101
cgaaagctcg gatcaccacg gcaagtgtgt cgaaccatgc agcatcttcg catcgcgtaa

41161
tgaagtgctc gaaaaggtcg gccctcgcgc ccagcgccca tttgagggtg cgaatatcgt
```

Figure 3 (Cont.)

41221
ggtctgtagt ttcggatacc gggcccgaga cgatggcggc gatcatctcg cgacgacgaa 41281
catctggatt ctccacgagg ttggccaggc cttcaagact tgaccatagt ggcccgtatg 41341
gattgccgcc ttctggatcg aataggagcg gctccaccgc cagagcctgc cacggggcgg 41401
ccgcggcttg ggggtcgcca tttgatgagc tgagcgcata tacgcgcctg agatcggtaa 41461
aacgctccct gtcaccttcc agaacgttca ggatgtagcg caccggagca tcgttcgcag 41521
tatagcccac caaaaccaag gtgcgacaac gcatgaggtc gaaaaggaag cgagcggccc 41581
agccggctcg cagatatgcc tccccatact gagcgctggt cagtaccagt tctgtttggg 41641
aaagattgag ctcatcgtcg gtcagccggc cgtgggtgtg gacaactccc gtgaacctcg 41701
cgctccctgg agcgggtata tcctgtcctg ccgcgctctc ctgcgtcgcg aaagctgccg 41761
aatgcgaaac catgagtgag cgctcgaaca gcgtgtcaaa gttcgtggtg acgataatcg 41821
gccttccaac ctgatcacgt gatagccgca ggatgacgtc gtgatgcgcg gtatcaggat 41881
ttgcgggaac ctgcagttct gcggccgcag cgtctataac atcctctgat cgtacaaggc 41941
gccgtgacag ggcacccaaa acttcttcat agcgagacgc ctggaaagca tggtcttcgg 42001
caggcgtgcg ctcttccccc aatcgattat agacgttgag cacgaggtcg cgaaaatttg

gcagttgcgg cgcgctgacc cctgcaccgc agagaaatac gacattccct tcgagcagtt 42121
cgtcgacgag cgcttccggg aaatcaggac cgaggtgatg aagtctcatg gcactctgac 42181
aagctcttcc aagttgaata ctgcgctgcg tcgcatgcgc cgacgctaaa ccaatgcatg 42241
aaacatgtct tggagaattg gaagcgcgat tgcggttccc tgacaagcgg ccgcgagagc 42301
ggcggctttt gcggctcgat tgttcagcgc attggcggcg ttctgcgtct tgaagacatc 42361
aatatcgccc tttgggccgg aggctaggat agccgcgggt ctccatccgt cttccgggat 42421
ctcgtgatcg aatggtacgg caattaccgt tgaccgccac cataatccag cagcggtgaa 42481
cgctgccatt gctgagagcg cgtttaataa ggtgactatc attttgcagt ctcgcagctt 42541
cgggatccac tgggcctata tgtagaactt aaacggctgt ttcttctcgc ctttgatcgc 42601
cgatcccatc gtcaggacat cgccgaccat tcgagcgaac cgcacggtga ccggaaggcc 42661
atcgttgaag ttgcaagaat tgtagttgat cttggtcagg cccatgatgt cggacagcac 42721
gtcacgaatc tcgggcttgg catccttgct ccgcgtcacg gtgacatgta gcggatttgg 42781
ggtttccggg ccgatatagg tatcaagctg cggaacgtat ccggtcgtcc aaatgtaggc 42841
tgtctgcgca tcgaggatca aggctgtgcc gcgcaacaca ggatagtctc catcgcggaa 42901
gagcttcatt tcgccaccgg ttgggcgaat ccgcacgcca acgacatttg tccccttcgg

Figure 3 (Cont.)

42961
cgccgcatcg gcaaacgcgg cccattcctc atcgttgaag taggtctgac catggatgaa 43021
gagctcctta ggcgcctcgc cgtgggtatc gacatagcta tcaagaacga gcttcaggag 43081
gtctttggct gcgggagcct tcaaatgata gtcgtagtcc ccggtcttcc aggggccgtt 43141
tgcaccacgg aaaacgacac cgtcgccctc gttcagaaac atttgcgccg cgcagcacgc 43201
gtggccatcg ggatcattgg gcaggctctt gtagaccatg ccgaggtagc aaacgccagg 43261
ccggatcgtc gataaccgcc acggtgggcg cggctgtgtc ttatagtaca gaccagtgcc 43321
gagattccag gcaaccgtgg cacgatcctg cgtcttgcgg gtcgggtaac ctgccgtatt 43381
gagaaacgcg cctggcgcaa gcgtggtttc tcgaatgagc tgcgtcggcg cgatgttcaa 43441
gaaatcggct ttgatgcgcc gatgaaaatc cggaacgtcg tcaaaaatgg tctcaccact 43501
ttgatcgata atacctgcca agagcggcag gctttcgcgc ttcttctgct tcttggcgaa 43561
atcccctttc tccgttggca gaccagtgcg cttagaattt ggtcggcacc tttcatagac 43621
gatctcagga agcaccagca cccagatgtc taccgcgcgc tcctcgttgt ggagatgttt 43681
gtttacacgc tcgatataga gcttcgcgac cttgtccact gcttcgtgct ggtttgtcac 43741
ccgcgtcgcg cgatcgatat ccgcgagcgg gatcgataat gcgctgagct cgtctgggtc

Figure 3 (Cont.)

```
43801
gtaggaaatt ccaaaggtct cttccaatcc cgggaagttc gcgaggtgca gccggttcgc

43861
cttttctccc ttcccgggcg ggggcacctt gacaatggat tgtagctcgc ggctccacgt

43921
ccggaagtga ccgatgcctt cacttgtgcc gatgacaccg acgcggattt ctttcgcctt

43981
tttccccttg agatggggtc cgtaaaggtg gaggccgtcc tttgggtgcg cgctcttctg

44041
accgaaggca aactcaagtt ccggctcatg gatatgatcg acctcaagcg atcgttccag

44101
aaatttcatt cgccgccctc ctcatcactg tcaggccgcc cgagagtgct gtcatccagc

44161
tcctcgtcct cgtcatctag gtcgtttgga agaacggtac tgaccggcga tgaaaacagc

44221
atcggcgatg cctcgataac gaaggtttcc gtctcggaaa gagggaggcg aacaaaagcc

44281
gattctccgg aaagcaattc tagaaacgcc agaagccgcc cgtaccactg cttgttgcgc

44341
cagcccttac agaccgatcg cctcaagcgg tgtagcttct tgggatcgtc gacaacaagg

44401
ccggctgggg tgtcgttatc ttgcgcaaac aggaccctcg acttcagctt gaagtgccag

44461
aacggccaga aagctggcat ggcagtcaca ccgaattgcc agatatggcc cttagcggaa

44521
ttgcgcagca tcgatgaccg cttcttctcg gcctggttcc cccacggaat tcgcttgccc

44581
gtcggcgcct gttctggtga cgcgtggaag ccgatgccat tcgaatatcc gtgttcgatg

44641
```

aacccgttgc gtttgcagta gttgaaccag gccttcttga gcatcgctac aacgaggttg 44701
gaggcaatct ggcggtcaat tcgcagtcgc tgaaagccgc cctccgtgaa ttccacgagc 44761
ggaatttcat gtttcagctt gaagcggccg acggcttcga atgccatttc gatttccggc 44821
acaccaccga atgccagaaa acctgatccc ccgaccaatg cgcaaggatg tccatagctg 44881
tcgatcgctc cctggaggcg ccctttgttg atcgatccag agcattcgaa gtatcggatg 44941
aaatctggcg cctcggcgac ccgaagccag tttgaggtca gtcgctcagg aacttcgatg 45001
atcggcacgg cgccgcgccg gcgatagatc tcccagttgg ggtttatcat cgtgtcgatg 45061
ctgcgctgga ctttttgccg ttgcagggta tcgatgagct tgagcaggcc ttctccccaa 45121
tttcgaacga aatcgaccgc gacagtgtca ccgagacctt tgatcttccg aaacgtctcc 45181
atgcgcagcg gaatgacaaa ccgctgatca ccgagttcct ttcccgtttc tagagcaatg 45241
tcgaggtcgt cctggatgct gctatcctca agactggaat cacggcagag aagcaggacc 45301
ttgaccgcgc gatggcgcag cgcactggtt atctcccttc gccaacgttc gccaggcatg 45361
agggtgagca cgtcggcaaa gacctggtag ccctcggcct caagctttgg agcaagccat 45421
agcgtgaact cgtcgtcgat gggtgaagcc ttgattatga agatcgtatc gcgctttacg 45481
ggctcgatcg gagcatcggc tgccccgggt ggcggcatca ggcgagcgag cgttttggga

Figure 3 (Cont.)

45541
acctccgccg gcgccattgc cttgcgcacc gcgttggtga cgacctcttc gagcactggg 45601
gtgctgtgtg cccagagccc ttcatgagcc ttcacaatct caggatagga tctgagcaag 45661
ccgttgaggt cgtccgcgcc aaatatgtcg ccgggtccga ctaggcttgg tccaatgatt 45721
tccgtcagcg ttgccttgtt tgccggggta agcggtacgg acgtcgtcag aatgtatcgt 45781
tgcggggcca gttcgtcgat tgaaacacgt tcttctcgca tcttcgactt gagtttcgag 45841
aagccagatc ggagatagtg cttggcctgg aggatgatcg aaccatcggc tttggcgtgg 45901
cgtccatcca taccgtcatc tgcgccaacg gtgaacgctt cgaatcgaac tccggtttcg 45961
gcgcccacaa gatcgcgact caggttctcg aagtcatccg gagaaagtgt tgagaaatca 46021
tacttcattt gtcggatgat gggtcgcgac aatactaggc gtcaaggcat caatagatgt 46081
cttctcagtt gtagtgcggt taccaacaac tctgatcgcg tgaaagcgct gactgcagtc 46141
ccgtttcgcc agagtcgccc tccgctgagc ccctcgtgaa accgaatacc ccagcactcg 46201
agaaatccgg aagcccgctc ggttctcaac tacgaggacg gatcggtagg taagggcccc 46261
acctgttcca aggtagcaga gactgccgcg ctgtagctgg gtttggcggt gacaaaatct 46321
cgaagcgaat accgctccgt agaacggcta ctgcgcacca agccatcctc ttcgacccaa

Figure 3 (Cont.)

46381
tcaaaggccg agataaacgc atgcaggccg ttcgcccgct cgtaccgagc atcatctcct 46441
cgcctctatc cgcacgctac cccgtcccgc gtgccgccaa ccctatcacg cgaaaagcac 46501
ctcggtgagg ttctccggcg gcgaccagag gccagccttg gccttaacgt aggtttggca 46561
aaacgtgacg atcttctcct gatcgccaaa tttcagctta tgcttggcaa tagtcgtgag 46621
ctgttcgaac gcattcgacg tgaaaccgta tgtcgacagg aagaggccac catctttctt 46681
ttcttcgacg atgatcttca agagcttttc cacggccgcc gatcccacct tcgtggatga 46741
acgccaatgt ttgatctcta cgtaatactc agcgagctta cccctcaccg tgcacgtcag 46801
aatgacatcc tttccaccat ccttcgaccc cggcgtaagc gtcacggcaa aacccaaccc 46861
ttcgaacacc tctgcgacga cctgctcgac catgcgccat tcgagatgat ccagggcatc 46921
cggacttttc gcgatcaatc gcgctagccc gctgcttaga tcccgcagca tgatccgaac 46981
ctcagcctcc acatcgacct tctcttcgcg caggcgactg atccaggcac gcattccgcc 47041
aatgtcgagc aattcgatcc taagcggcaa gcttttctcc actgcggcat gcgcctcccg 47101
cggaaattcg ccgttgctca ccagcacgac gcgagtgaga tcctgcaaca atgcagcgcc 47161
gatcaacttc tgcagatctg ccatccccac gcggctaaca gtcttcctgt aaaacttggc

ctgaactccg atggtctcgg cgggtgcaga actggtctca tccgccgtac gcgaggcgcg 47281
gaaatcgatt ccctgatcgt tcaatccgcc agtatgctca acctcgtagc cttcgatccc 47341
gaaaagcggc tccaacacgc ggcccaggac caattccgac tcttggggat cgaggctctc 47401
gttcgcccgc aatttattga gctcgagatc gagtgcatcg cactccgctg cacttagttt 47461
tcccaacaac cgccccaacc gcgtgctcct tccaatattc ccatacctaa ttaccaaacg 47521
gatttggtga tacccgtaga gcctgacttg agggttgaga aagccgaatt tgaaagtgtt 47581
ggtgtcaatt ttaacaacat gtcgcttccg cccagcaaag gtgggacatg cacgcttggc 47641
accaggatct cgtagaccca ctaccgccga aaaaaggggc gtgggcttat atcacccccc 47701
acgcccgaaa cctccccctc cccgtcatct ctctcaaccc cagctccgtc acgatccgcc 47761
gcgccgcctg tggggtgacc tcgagcgtct tggacaccat cccggccgaa acgagcggtt 47821
ttgccatcac aagttcgacc agctctggca gttttgacga ggtccgccgt ccgtccagct 47881
ttcggtccat catcgttttc gccagcgtca gccgatcatg ttctttcatg ccgatctcag 47941
cagccgccag caaaccgtgg gcgatggcaa gcagccgggt ctcccggccg cgatggcggc 48001
gccgatcgac gggtatggtt ttcagaccga gattgatggc ggcaagatgg gcgccggtgg 48061
tgatgccggc ttcccgcagg attgaggcgc aaagcagccg gccgagccag ggcgcgtgct

Figure 3 (Cont.)

48121
gcaggacaga cagttcgttc caggcatcaa gggcgacgat cgcctgcagc accgccggca 48181
agtcttgagc ctggcgcagc acgctgcgcc attccaccag ccgggcgtcc tcatcccaat 48241
cgaggtcgta gaccagtgga tccttctcgg cagcccagct gttcgcgccg gcacggccgg 48301
gtcgccttgc gtcttcgatc gcggcctccg aacgtgccag caccgcatcg atggcggcat 48361
aatcgacgcc gggcagatct ttggcgtcgt taccatcgtc cccctcccct tccggatcga 48421
tagcgaccgc gggccgaatg acgtcggccg gctccaccgc ctcgacgccg accgggttga 48481
tgtccgacgt ctgtcgcaaa gttcggatac cctctgtcga taacggccaa tctggcgact 48541
gcgcagcgat gcgccggcgg gtccgcaaga cgtcgcgggc gattgtcagt tcgtgggttg 48601
gggtgcggat gtcgcgggta gcgtcgtgga ggacgaggtc ttcgagatgg acgagttcgc 48661
cgtcgatcca gagggaggcg caggcgtcga ggaaatgcat gcgctcaatc cacccgcttc 48721
cgaccggtga gcgggcgatg cgctcgtcga gacgcgtgaa accgatgccg gcctcgaaag 48781
ccggccgcat cagggctgtc gtgctgattt tcgccagatc ataagccatt gaaattatgg 48841
taaacaattt tctaaaggaa ctctagtgca atattactgt tcctcacatc gtacgctttc 48901
gggttgcttc taaccatcga taggtttcca gtatcgatag ttatggattt ggcgttgcaa

Figure 3 (Cont.)

48961
atcacctacg tcggtcgtac cagatcgggg attcgcctgg aaacccgggc ttttcagccc 49021
cttcctcacc ctctttcagc gaactcattc ccctgatcga gtgaactgga cctctgccga 49081
gcggccgacc gcggagccgt cctccggcta tttcatcatc ccggcctgtc agaaatgcaa 49141
cggtggtacc cgatcccatg cgtaacaggg gatttcatcg catttcggcc acagaaggcc 49201
gctggcgcga tttcccgaac ttcgacggtc cgagacctgt tgcagaccag attccgcgct 49261
gtacggcctt ccattttgaa cataaaacac gcttgcaaag gagccttttc tcacacatgt 49321
ttcatttgta caaaccgccc cgaaacgacc gaaaaattcg atggcaacgg ctgcatacct 49381
caattctcct tccctgcagc aaaggctgat cggatacgcc cgtgtttcga ccgaggatca 49441
gctcaacgac gctcaggtcg acgaattgcg ggcggctggt tgccaccgca tccaccagga 49501
gcacggatcc ggcgcatcac gcgcgcggcc ggtgcttgcg aagcttctta aagaccttgc 49561
catgggcgat gtcctcgtcg tcgttcgcct cgaccgtctg gcccgatcgg tcagccacct 49621
gctcgacgtc atcgaagacc tcgagaagcg cggcgtccat ttccgctcgc tgcgtgatcc 49681
gatcgatacc tcgacgccgc acggaatgtt ttccctgcag gtgctcggcg ccgtcgccca 49741
gctcgagcgc gcgctgatcg cggagcggac caagtccggt atgcaggccg ccaaggcgcg

cggccggctt gccggcaatc ccgggcttcg agaacgccgg ccagaagcca tccgtgcggt 49861
ctcagcggcg cgcgagcggg cctacctcga tgaactgatt gtgtcagcgc agacctggct 49921
gccgacagtc cggcgactgc gcccgcgaca cagttgggac aatgtcgtgc ggatcctcaa 49981
tcgcaggggg cacgactgga ccgtcgaacg gttgcggcgg gcggtccacc ggctagtgcg 50041
cgaaaagctc gcggaaccgg aactgcttgc ccgatcgctg cgccggccgc ccgaggatca 50101
tctgatgcgg ctggttgccg ggatcgccat cgccgatccc aatctgtcgc tgcgcgacat 50161
tgccgcccag ttggaccaga tgcaggagcg accgccacgt ggcggccgca aatggcaacc 50221
gtcttccgtc cgagcactac tggacgaggc gagtcgcatc gggctggttc gcgcttgaga 50281
ggcttggttc atgaattcaa gagtgttcac gcggcgtcga aagacgggtg cggcactgtt 50341
tccggtcgcc gcatgcttcc aaatggaaaa agaccgagca acccccgggc tattccagaa 50401
agctcgcgtt gtgaggaagg ggccgcctag gcctgcaaat tgtcagccga catcttgccg 50461
gacttacgat cctttaccag ctcgtaactg atcttctgcc catccttcag ctcccgcagg 50521
ccagcccgct ccaccgctga aatgtggacg aagacatcgg cgctcccgtc gtccggctga 50581
ataaaaccaa agcccttcgt cgcgttgaac cattttaccg ttccggtcgc catcatgcct 50641
tccttcgatc atttgccgta cccgccacag ggcgggcgag gctcgcttcg tatacgcgcg

Figure 3 (Cont.)

50701
cacagataga cgcttctccg ctccgggtaa agcagcccga acgttgacgc aactgcccag 50761
cccaagcaag cgatcttcgt cgccatagac gctacttttt gcctctttgt ttcagccgcg 50821
atgctgacgg gagcatcctc tgcttgccac acgtcgaact gatttgtcgt acagataaga 50881
tcactgagtt ttcggaaccc aagcgtgcac gggtcgaagt ccggcgccag gtgagacctc 50941
catttgccgc agagcctcat ccgaggcgcg ctttccgcag agccccgcaa ggttggctct 51001
ggcggctgaa ctcgtcgtcg cgagtcgtgg gctaggtgcc tgagtcgccc tcgatgccga 51061
cgcgcgacac ggcgatgctc gcgctgactg cctttctcta ggcaacggtg atccccgcgc 51121
tcaccggcgc ggttacgccg ggcccggccg acctcgatgc gctcgccctg aacgtgttcg 51181
attgaatgag gaacccgttc gaggatcatg ctcccgcgcc acctgatctg ccccacgtac 51241
agatcagtct gcccgttcga gtaccgctag acgctcgcgg taagatggtt tctactgccg 51301
aagcaggaag ttggcgcgct ccatcagcca gtacagcgct tcctccgaga cttcaaaatg 51361
gcaagggaac atttcgacag gcaacacagc agagcccaac ggttgcttga gcttagccgt 51421
gtggcaatct cccgcgactg ggacaaacac gcggcgttcc tgcccccgtg ccgttgaggg 51481
cgcttatccc actctgctac taaccctgac gaaccacggc cctcccctcg catagcctga

Figure 3 (Cont.)

51541
cgttcctgcg cgacttggcc gaacaccggg acagcggctc gtcgaagctt ggccgcgcga 51601
actttctcgc accgcgcgcg atcagctgcg accggcgtcg atatgaccgt gtcccacttc 51661
aaccggtcgg aggccttgtt cgagtattgc ggctcagcga gcttgccgtc gctgacgagg 51721
acgagaattc cgaagtccga ggaccgccca acgttgtgtg gggatcgact acagcgtcgc 51781
aggcatagaa gccgaacata atggtcttca gggtccgccg cgcttcttga aagcagtgga 51841
gctgccttcg agcgcatcta atcgtgtgag cgcgggaacg tacgggaaag cccgtcgccg 51901
aggctgctcg gggcacgctg gcaaggggca cgaccctgtt cgtcgtcgag tttcgttgct 51961
tcgcctgcct tcgtggcagc gtcttagcct gcgttccagt cgctgttgtg ggtagggatt 52021
ttcctccttg cacatcccga tctccgccgt ggtgaggcct tcatggaagg ccgacagtac 52081
cgttgccatc gctgccccg aacttcgtta cggccctcgt caacccgccg gactgtacca 52141
aattggcgaa gcgtaagcgc gctgcgtcaa tcgaactcag gaccccttcc cgcctctgat 52201
tttaattgag caggaacata cggtagaaca tcgaatagcg aacgaaggtc ccaggaccac 52261
cgcggccggt caatcagagc gccacacgtt gatgtctcac cgaccaggaa caggtccgtg 52321
ccaaccgacg aagcctcccc tgccccaccc tgcgtttcaa tccgcctcga ccgcaccaaa

acgacgacga gcgatgatga cgaacatgtg ctcttgatct gccggccggc gatcgccttg 52441
aaacgctggc tcatggaagg ccggaaccaa cagcgcggtg gtgttccgca tctaccacat 52501
gaagcaaata tcgaccggcg agcgctacca gccgcatgaa atacgcttag ccaagcgata 52561
actaatgctc tgttggaagt gtgacagtca ttctggcaga atgacgaaac gcggtcacct 52621
acggactggc taaactttac gactcgcgtc ctacaaacag gcgatcaacg cctcgaaagt 52681
tcgaccgaac ccctcccttc aacagcaaac gaagacagtt tagaactaac gctctgatta 52741
atttgcgcaa atttccgttt ttgtcagctg acaacttttt acagtctgtt ttaaggaagc 52801
aatagtctcc cctgcctttg caaccaacta aaaatcaaga tctggtgtag catttggcct 52861
ttcacagcat cgtcctggcg ctcaagaaac atctctggtc tgatgctcga atgcctccgc 52921
caacttctcg gacaccatgc tgagggagct gcggactggt cgggcttgtc cctgcctttg 52981
gtgtcgtcca tattgccatc gaatgtccct gcctgcactg tcctcgtacc gacgtggacg 53041
attggagttg ctccccctac tgagacacca taaacgaaag cgtcataact tctcctaatc 53101
ggttgactca acgtcccaat ctgccgattt tgtcagccga caacaagcgg tcgcccaaga 53161
gctgagggga ttggttcccg ccgattaagc gggttcttcg gtcaggaggc caatcgatca 53221
cttccgccgc gcgccctcag cagtgccatc aacactggcc ccggcgaaaa ctcgccccgc

Figure 3 (Cont.)

53281
tttgcccgag acgttaggtc gcggagatat ccgccgggcg atttgatgtg ccctgaccgc 53341
tccagaatgc aggccatgac agcggatgcg ttctcgggcc ccataacctc acaggcatcc 53401
tggtaggccg acggactgac gcagagcatc gagcggacga ccactgcggc ctgcatcagg 53461
tcacgcgggc tcgcaactac gcctccgggg ccataatctg agatgcttgg gcaagcccgc 53521
aacaccatcc ccaacggaaa caccttcatc ggctcgcgtt gcggttcgat ggctgggctc 53581
ggcctttcgc cctgctcttc tcgagagcta ggttcaaatt cattagtgga ttcgggatgt 53641
gaattctgtt tgtgccgctc aatttgatca ggattgccgc tcaaattttc gatttttaac 53701
ctgatttcca gaaggttgga gatttcctcg cgcaacatct ccatctcttc gaggatgggg 53761
gcgacggtcg cggccgttgc cactcgagga atggtcgcta ctaggctgcg gtagtgctgg 53821
tgaattccgt cccaattacc gtccactccc tcctcaatgg cgacttcaat cagcttaccg 53881
atatcgcgcc ggcagatcgt caggcgctcg cgaagtctac gcaattgcag tcgctcaatt 53941
ttgacatagg cagctatttg ctcgatctcg cgtgcgcgtg acagcaacgg agccaacgaa 54001
aacccatagg cctcatcgat cgaaccgtct ccgtccttgc gggcgtagcg tttgccattt 54061
gggctatccc ggcgtgccag aaggccagcg tcgacgagcg ctgcgatgtg gcgacgcaac

Figure 3 (Cont.)

54121
gtcgcttcag ccatgccatg cgcacgaagc gacaactgca tgttagaggg gaacacgatg 54181
aggccgtttt cctcagacaa ggtcgtctcg ggataaaagc tcaaaagtgc gttcataaca 54241
gagagcgcac gttcgctgat gccgagcttc ggcttagctt cgcagagcgc tcgaaacagc 54301
ttccacttgt cagccgatgt ttcaggttcg agttcacgcg acatatattg gcttgccaac 54361
atgccaagcg tcatcgaccg ccgcccgaag ggcgtcgtca cacttccatc ttgcatcttc 54421
tttcacctat cctcaggcaa aagacgtccg ctcacccgtt ccggtgccaa agactcttga 54481
ctgcgattcg tggaaatgcg attctcaggc tgctaaacga tgagagaggc ttccacgatg 54541
gttaccgtct gggggccttt ttcttttgcg tcagtcttcc ttccgattac cctgctccag 54601
gaactcggca tagagccggt ccaggttgtc tgcaatatac cgcccaaagg ggccggcatt 54661
ccttgatttc atagacaagg caaacgcctt ggcggagttc gaatacttag cggagacggt 54721
cttgtccgcc ggttgccagt tctccaggat ctttggagtc gtcttccgga caggcttcgc 54781
cgcgctgttc agaccagaaa acagggaatt gaagcgatcg tcagtgctca gttcattgaa 54841
ggaaggatca gagacgattg ccttcacctt cgcttcgttg gcggttttac ccacaagcaa 54901
tgacaactcg acccagcgtt ctcggccgac cgccgggcag ggcccgattc ttgcgattgt

ctcttcagga atacgatcta ttacggcgat cattttcgag atagcggccg cattggcagc 55021
aagcgccgat cctatgattg tccggtcata gccaagcttc tcgaggtgcg aggcgaagtt 55081
cgcccgttca atgaaggaga ggttggcgcg cgccgagttt tcctgtccct gggcgataac 55141
gtgcgtgcgg tcatccagcg ccttgacgac cgccttaacc ttgcggccga gctcgcgggc 55201
aacgcgggct cggcggtgtc caaagacgat ctggtaacga tcggctgccg acgggtgggg 55261
gcgcacaagg atgggcgtat cctgcccgcg ctcggcaatc gcctgcttca attcctcgaa 55321
ctgctcggaa ctatcgccca tgcgatcaga gacgaacgaa ccatcgagtg tctcagggtc 55381
gagttcgacg accgtttctc cttcgagaaa tttctcggcc tggcgcgaca actcgtcgag 55441
cgagcgcacc atgctcttcg aagccccgcg catcgggtag gcgggcgcaa cgtctgcgtg 55501
cgggatttcc gctgtgtcta ccagtcccgc cagtaggttc tttctcgcca tgtgcctgct 55561
ccgtttgcct gagatctacc gggccgtccc ggggaagttt acacttctca actgacaacc 55621
ttcctccccc aagaggcatg gacgagttcg acgatctcgg cgttgactgc gttcaaggag 55681
tccatcgcgc gctcataggt ggaccgcgtc atctgactct tgtcgacttc gtaaagggtc 55741
tgcttggtga ttccggcgtc tgaaaccgct gtcgatttca gcatctggtt cttcagcaca 55801
aactggtgga acaaggtctg catgaagccc accatctgcg cctgcggccc atccgttggc

Figure 3 (Cont.)

55861
tcgtaccggg tgatcagata gcgataccat tcgagattga ccgcagcacc cacatcccgg 55921
atcggcttca ggatcccgcc cagcatcaaa aggaactggc ccatcgacat gacgtcgagc 55981
atctgtggat ggatcgtgat caggacgctc gtagccgcag tcagcgcggt gatcgtgaga 56041
tagccgagct ggggagggca gtcgatgacg acaacgtcat agcggtcgtt gacttccgac 56101
agcgcgcgcg aaatccgcgt gaagaaggtc ttgccatcgt tcgagctctt gttcgacatc 56161
gcaagcgggg tgtcgtactc gtactcctga agttcgaggt tcgcaggcac gatatcgagg 56221
cccgggaaat tggtaggctg gatgatctca ctgatcgatc ggcgttgatc gtcatatctg 56281
agcgcctcat agagcgacgg cgacatgtcg agttcgggct gaaaaccgtg aagcgacgaa 56341
agtgacgcct gcgggtcgag gtccaccgcc aagacacggt gcccggtcaa cgccatgtac 56401
tgcgcgagat gggcggccgt cgtcgtcttt cccgaaccgc ctttgaaatt gacaacggca 56461
atgacctgga gcttttcgcc cgaccgacgg tgcggcacgt agttcctggc ttccgatcgt 56521
ccatgctgat cgagatactg acgcagttcc gccatctgct cagcactata agaacggcga 56581
cccgacgacg atgtctgggg gagggggcct tttccctcaa gatgaagttt cttcagcgta 56641
ctttgagaga cgccgaggaa ctgcgccact tcagagagcg agaactggcg aagcagtttc

Figure 3 (Cont.)

56701
ttggcattcg gtgggaactg ctgcatgctt aaaagatgca atttctttga aatcagatcg 56761
ccctgttcga ggatgagatc ctcgaaatgc atcggctgtg cgggagcgat gggcggcgaa 56821
ttagcgttca ttgcagggga actctcgaat aacggttttt cggcccgaga accgacataa 56881
tcgttattat gtgcgattct cgccgactga caaggaatat agagttaaca aagggtttat 56941
accgcgtccc gagcagcccc tgctcgccgg caaaacatgc gtgtttctcc ttcattccta 57001
ggcacttaga tggacgcttg cgctccgcca ggcgccagca cttttccagg ggagaaatac 57061
ggccgttcgc ctgactacca aacgtcaccg cgaaatagcg gtcgtattgc tccccgcgac 57121
tcacccgact cagccttggt gaatatattc gagttctgag ttgctgcggt tgcccggaaa 57181
gagagccggg gcacataact ttgctgccaa cttcttcatt gggcccagca attggttctg 57241
ctcgacttgc tttcaccatc tgtccctctc tgcggcgtac tgtccgttac aggccatgcc 57301
ccgcaaaaat agaaggtgat tcttcctgac cgtccagaag attgggattg acaatgggtt 57361
gaaaagaccc tgcttggctc aagtgagccg aaggattact ttcgcaaatt tgtatttgtc 57421
cgctgagggt tagacgcgga tcacggccgt ctatggacac gaattgttct cctgtgaatc 57481
ctacaagacg caagggggcc ttcgggtctg caaaggcaga cgtgacgcga cgcaacgccc

aacgcgttcc agggaacctt gtaggatcct acaactgcca cccgattccg atttgtgctg 57601
atttccccgc ggtccaacaa cgacggagaa attcatgcag attctcgcga tctcaaagcc 57661
gcgaaatatc gaagaagccc aacttctccg cagccatcac gaactgcgcg cccgcgtctt 57721
ttccgatcgt ttgggctggg aagtcaatgt cgtcggaggc tgtgagtcag atactttcga 57781
cgatcttcaa ccgacctaca tcctagccgt atcgagcaac gatcgagtgg ttggatgtgc 57841
tcgcctactg cctgcgctcg gccccacgat ggtggccaac gttttcccct cgctcctttc 57901
tgccggtcac ctcaacgctc attcctctat ggtcgagagc tcgcgctttt gcgtggacac 57961
cttccttgct gagagcaggg gagacggctc cattcatgag gcgacgctca caatgttcgc 58021
ggggatcatc gaatggtcgg tggctaaccg ctacaccgaa atcgtcacgg tgacggatct 58081
tcggttcgaa cggatcctcg cccgcgtcgg ttggccgctt cagcgcattg gcgagccaag 58141
gccgatcgga gcgaccgtgg ccgtggcggg cactctgccg gcaaaggcag acacattcat 58201
gaggctccgc cccgccaact accgctctca aatcatcagc acttttggcc aatcagcgta 58261
aggagaaatc agtggaacag cttcgctctc atcctcgcct cgtccgcaag cttcaggagg 58321
cgcttggcga ccagctctgc gttgctttgg acgatagcaa cgtagtagag ataatgctga 58381
atcccgatgg taagctgttc atagaacggc tcgggcacgg cgtcgcgccc gctggcgaga

Figure 3 (Cont.)

58441
tgtcgtcggc tgcggcggaa atggtgattg ggacggttgc tcatgccctc caatccgaag 58501
tggacaccga acaacccatc atttccggtg agcttccgat aggcggacat cgtttcgagg 58561
gtctattgcc gccagtggtc gcgaagccct ccttcacaat ccgtcgtcgg gcatctcgcc 58621
tgatcccact cgacgactat gtccgctccg gtgtgatgac cgaggcccag gctgcgacga 58681
tccgcagcgc cattgactca cgcctcaaca tcatcatttc cggtggaact gcctccggca 58741
aaacgacgct cgcaaatgca gtaatccatg agatcgtgag gagcgcgccg gaagaccggc 58801
tcgtcatcct cgaagacacc gccgaaatcc agtgtgcggc cgacaacgcc gttcttcttc 58861
gtaccagcga tacggttgac atggcgcggc tgctcaagag cacgatgcgc ctgcgtcccg 58921
accgaatagt cgtcggcgag gtgcgcgatg gtgctgccct caccttgctc aaggcatgga 58981
acaccggaca tccaggcggc gtggcaacaa tccactcgaa cacggcgact tccgcgctcc 59041
ggcgcctgga gcagctgacg gccgaagcaa gccaacagcc gatgcacgag gtgatcgggg 59101
aggttgtcga cctcatcgtt tccatcgagc gtacgccgcg aggccggcgt gtgcgcgaca 59161
tcatccaggt cgagcgcttc gccaacggcc gatacgagat cgaatctgac caactcaccg 59221
aagaacggga ggagcggcat gtcgcgtaag aatgaattta tctccatcgc gcttcttgct

Figure 3 (Cont.)

59281
tcgccactca ttttggcgtc ggtagcaccg gcactggcca gttcaggcgg cagtctgccc 59341
tgggaaggac cgctcgagca gatccaggag tccatcacgg ggccagtcgc gggctacata 59401
gcacttgcgg cagtcgcgat cgccggcggc atgctgattt tcggcggtga gctgaacgat 59461
ttcgcgcggc ggctgatgta tgtcgtgctt gttgccggca tcctcctcgg cgccacgacc 59521
attgtcggcc tgttcggcgc gaccggcgct tcgatcggcc tgaccaatga tcgcgccact 59581
tcgacgcgcc cgagtgcaga aggggagggg gcacatggct gaggcgctat ccgaacgtta 59641
ccgcaatcgc attcaccgtg cgctctcccg gccgaacctc ctgatgggcg cggaccggga 59701
actggttttg atcaccgggc ttgccgcggt catcctgatc tttgtggtgc tgactgtcta 59761
ctcggcgctc ttcggggttg tcgtgtggat cgtgatcgtc ggcttgctcc gcatgatggc 59821
gaagtccgat ccgctgatgc ggcaggtcta tgtccggcac atttcctaca aaccctacta 59881
caaggcgacc acctctccgt ggcggcggta ttgaggaggc tgatatggtc gcgctcaaac 59941
ggtttcgggc aaccggccca tccttcgcgg atctcgtccc ctatgccggc ctggtcgaca 60001
acggcgtgct tctgttgaaa gacggaagcc tgatggccgg ctggtatttt gccgggccgg 60061
actccgacag cgccacagac ttcgaacgca acgaactatc gcgccagatc aacgcaatcc

tgtcgcggct cggaaccggc tggatgattc aagtcgaagc cgcccgtatc ccgacgtacg 60181
attatccctc ggaagaccgc tgccatttcc ccgatgctgt gacgcgcgca attgacgctg 60241
agcgacgggc gcatttcgcg cgcgagcgag gacattttga aagcaagcat gcgctgatcc 60301
tgacctatcg gccgtcggag gccaaaaaga cagccgctca gcaaatacat ctactcggac 60361
ggggagagcc gtaggaagac ctatgcggac actgtgctct tcatcttcaa gaacgccatc 60421
cgcgagatcg agcagtattt cgccaacacc ctttcgatcc ggcgcatgga aacgcgcgag 60481
gccgccgaga ggggagggga gcgtgtcgcc cgctatgatg aactgctgca atttatccga 60541
ttctgcatca ccggcgaaaa ccatccgatc cgattgccag ctgctcccat gtatcttgac 60601
tggatcgcga ccgccgaact cgagcatggt ctgacgccga aggtcgagaa ccggttcctc 60661
ggtgtcgtgg cgatcgacgg gctccccgcc gagagctggc cgggcatcct caacagcctc 60721
gaccttatgc ctttgacgta tcgctggtcg tcgcgcttca tcttccttga tgcggaagag 60781
gcgcgtcaga agctcgaacg cacgcgcaag aagtggcagc agaaggtccg gccgttcttc 60841
gaccagctat ttcagacgca aagccggtcg gtcgaccggg acgccatgac aatggtggcc 60901
gaaaccgagg atgccatcgc gcaagcgtct tcgcagcttg tcgcctatgg ctattacaca 60961
cccgtgatca ttctcttcga cagtgatcgc gaagcgctgc aggaaaaagc cgaggctatc

Figure 3 (Cont.)

61021
cgccggctga tccaggccga aggatttggg gcgaggatcg aaacactcaa cgcgaccgag 61081
gcctatctcg ggagcttgcc cggcaactgg tattgcaata tccgcgaacc gctgatcaac 61141
accagcaatc tcgccgatct cattcccctg aactccgtgt ggtcgggaag cccggtcgca 61201
ccttgccctt tctatcctcc caattctccg tcgctgatgc aggttgcaag cggttcgaca 61261
ccgttccggc tgaacctgca tgtcgacgac gtcggccaca cactgatctt tggtccgacg 61321
ggatccggca aatccacgct gctggcgctg atcgcggcac agttccgacg ctatgatcgt 61381
tcccagatct tcgcctttga caaaggaagc gcgctcctac cgctaacgct ggctgccggg 61441
ggcgatcatt acgagatcgg cggcgacaat gcggaagggc gtaaggcact ggccttttgt 61501
ccgctgtcgg atctcgaaag tgacgccgat cgggcttggg ccgcggagtg gatcgagatg 61561
ctggtcgctc tgcagggtgt cactatcacg cccgatcatc gcaatgccat gtcccgccag 61621
gtcaccctaa tggccagcgc tcccggacga tcgctctccg atttcgtgag cggcgtgcag 61681
atgcgcgaga tcaaggacgc cctgcatcac tatacagtcg acgggcccat gggtcagctt 61741
ctcgacgccg agcacgacgg actatcgctc ggcgcctttc agaccttcga gatcgagcaa 61801
ctcatgaaca tgggcgagcg caatctcgtc cccgtgctca cctatctgtt ccgtcgcatt

Figure 3 (Cont.)

61861
gagaaactgc tcgacggctc gccgagtgtg atcgtgctgg acgaggcttg gttgatgctc 61921
ggccacccag tattcagagc caagatccgc gaatggctga aggtgctacg gaaagccaat 61981
tgcgccgtcg tcctcgcgac acaatcaatc tccgacgcgg agcgttccgg catcatcgac 62041
gtgctgaagg aatcctgccc gacgaagatc tgccttccga atggagccgc tcgcgaaccc 62101
gggacgcgcg agttctacga acggatcggc ttcaacgagc ggcagatcga gatcatttcg 62161
aacgccactc cgaagcgcga atactatgtc gtcacccctg aaggccggcg gctttttgat 62221
atggcgctcg gtccggtggc gcttagtttc gttggcgcat ccggcaagga agatttgaat 62281
cgcatccgaa cacttcattc cgaatacgac cgcgactggc cggtccactg gcttcagatg 62341
agaggatttc acgatgccgc gtcgctgttc aatgtcgaat aatttgctcg ccggtctggc 62401
ggtcgtcgcc gtaacggtcg gcacagggga gccggccgat gccggcaccg ccactggcgt 62461
cgcaaccgag tggacgcagg ttctcaacaa tggggagctg gttgccctgg tggggaagtc 62521
caatgagcaa attcagaacc agctcaccca gatcagccag ttcgcacaac agatcgagac 62581
gcagctgaac atctatcaga acctgctcca gaacacggcg acgcttccgt ctcatatgtg 62641
ggggcaggtc gagcgtgatc tcaatcggct ccgcagcatc gtcgatcaag gtcagagcat

cgccttttcc atgggcaacg ccgaccacgt actgcagcag cgattccaga gctatgcaac 62761
cctcaagacc aacctgccaa ggaatgagac attctcctcg acttatcaag cctggtcgga 62821
caccaaccgc gatacgattg ccagcacgct gaatgcggcg agcctcacgg ccgatcagtt 62881
cgacagcgag gaaacgacaa tgtcctcgct gcgctcgatg tcagagaccg ctgacgggca 62941
gatgaaggct ctgcaggtgg gccacgaaat cgcggcccaa caggtcgggc agatgcagaa 63001
gctccgcggc cttgtctcgc agcagatgac catgatggga acctggctcc agacggagca 63061
gaccgacaag gacctggcgc aagcacggcg ggaaaaattc ttcaacgccg acgtcaagag 63121
cattccggaa ggtcagaaaa tggagccacg ctggtgagcc gcgccgttat cattgcctta 63181
gtgatcctcg tcgctgcggt ttcgaccaca gcgacagcgc tgatcgtcaa ctccagagcc 63241
tccaacccat ccgcacctga ggagcaacgc accgccaaag aaaaattctt cggcgcgggg 63301
aaggcgcttc cgccgatcaa ggatggtcag gagatgggtc caagatggtg aagatcagtc 63361
ttgcacgttc gttgctgatt gcaggcttgg cttatgtcgc cttcgaggca cgcgctttcg 63421
cgcaggaagg tctagtcctc acggagttgg agaaccacgt ctcggcagcc gcgaaaggat 63481
gggaaaccac catccttgac gcggcgaaat cgttgttttg gattttggcc accatcgaga 63541
tcggcatcgc ggccgtctgg ctggcgctcc aggcggcttc gctcgacagc tggtttgctg

Figure 3 (Cont.)

63601
agcttgtccg gcggatcatg ttcgtcggat tttttgcttt cgttctgacg cagggcccga 63661
ccttcgcgcg cgccgtgatc gatagcctgt tccagatcgg cgctggcggc ggatcggcat 63721
cccccgctga aatcttcgac gctggcattc gggtcgcctc acaaatgtcg cagcaagccc 63781
agttcggcgt cttcgaggac aatgcgctcg caatcgctgc ggtgctggcg atgggtgtcg 63841
tggtcatctg cttttcgctg gttgcagcaa ttttcgtgtc ggtcatggtc gagatgtatg 63901
tcggcctgct cgctggcatg atcatgcttg ggcttggcgg ttcctctttc acgaaagact 63961
tcgctgtccg atatcttgtc tatgccttcg gcgtcggcat gaaactgatg gcgctcgtga 64021
tgatagctaa gattggatcg caggtcctct tgggcctggc gaatgctcca accgcgtctt 64081
ccgaccaatt tgtcacgacc ctggcgatcg ccggcatctc cgtcgtggtt ttcatcatcg 64141
ccatgtacgt gccgagcatc atccaaggtg tagtgcaagg cgcctcggtt tccgggggga 64201
tggaaacgat ccgtcacggc ggccaggcgg catccttcgc cgccggcgct gggttcctcg 64261
cgggcggcgc cgcgagaacg ggtttcacgg ccggtcagtc ggcacgagcg gcgggttcat 64321
ccctcgccgg cgcggcgctt cggggtttcg gcgcggggat cggatccgcc agcagtgctg 64381
ctggttctgc cgccaaggaa aaggcgatcg gttcacccgg cgcctatgcc ggatcaatcc

Figure 3 (Cont.)

64441
tcggcctcgc caacgccaag ctcgatgaga gccggggcgg tcatagcggg cacaagccac 64501
ctcccgaacg caaagactaa cagcaatcag aaagtgatag acgatggcag cgaaccgcgc 64561
ccccgaaaac ccctatcttg ccgcgcggca ggaatggacg gaacgatacg gatcctatgt 64621
gcgagccgcc gcggcatggc gcacagtcgg cattctgggc ctggccatgg ccgtgatcgg 64681
tttcggatat gctatgtatc tcagcaccga ggtcaagctc gtgccttaca tcgtccaggt 64741
cgacaagctt ggcacgtcgg tcacgaccgg tttccccgaa cagattgaat atgcggatgt 64801
gcgggtagtg cgcgccacgc tcggcaattt cgtgaccagc ttccgttcga tcacgccgga 64861
cgccgcggtg cagaaacaat atatcgaccg cacctacgtg ctccttcgga cctccgatcc 64921
gtcgacggag aagatcaacg cctggttccg aggcaattcg ccattcgaga aggcaaaaac 64981
cgcaacggtc gcgatcgaag tcaacaacat cgtggcgctc tcaaaccaga cctatcagat 65041
cgactggacc gaatacgaac gggaccgcaa gggcaaggag atcggcacgc gccggttccg 65101
gggcatcgcg acggtgacac tcaccgcgcc gcaggacgag gcaaccatcc gcctcaatcc 65161
aatcggcctt tatgtcaggg attttgactg gacagcgcag ctttaagggc aggggaattc 65221
tcaatgcaca gaaccggatt gatcgcagcc gccggctgcc tggcaacact cgtctttgcg

agcgccgctg aagcgcagag catgaccacc aatgaggtga agggcaccag tatttcgagg 65341
aaatggcgcg gcacggccgg gttggtgacg actggtcccg acggcaaggt catcttcctg 65401
ttcggcgaga cgcagccgtc ggtcgtctgc tcgcccttgc aggtctgcga tatcgagttg 65461
cagggcggcg aaatcgtgcg tgacgttctc gttggcgata gcgtgcgctg gaaggtcgaa 65521
ccggcgacct cgggtgccac cggcgggcag gcgatccacc tgatcgtcaa gccgtcggag 65581
ccaggccttg tcacctcgat ggtggtcacg acgtcgcgcc gcacctatca catccagctg 65641
aaatcccatc cgagccagta tatggcgcgc gtcggtttcg agtatccgga ggacgtttcg 65701
acgaagcttg ctgacatcaa ttcaaggctc gagaccggcg gcattccagg aacggcaccc 65761
gacaagctga acttctccta ctcggtcagc gggagcgcgc cgtggaagcc gaaacgggtc 65821
tattcggacg gcgcaaaaac ctacgtccaa ttctcgaaat cgatctccgg acaggacgcg 65881
ccggtgcttt tcgtcgtcag cggcggccaa aaccgcatcg tcaactaccg catgaacaat 65941
gacatgatga tcgtggacta cgcggtcgac aaggcgatcc tcgtctccgg cgtcggctgg 66001
cggcagcaga agatcactat tcggcgggga ggctgaacga tgcggaagct tctgatctcc 66061
tttgttacgg tggctattct ttccggctgc caaacggccg aggacgggct gacgaccagt 66121
tccacgccaa ccaccgtcac cgggcccgcg gcgagcgcga ttgccggcga tatggcaagc

Figure 3 (Cont.)

66181
cggctcgccg agcagatcgg cccgtctgcg acgatgacca tcaagatcga aaaagactcg 66241
tcggatttcg cgagcgcgct cgaggcggcg ctgaaaggct ggggctatac ggtcgtgact 66301
gatggcaagg tcggcagggt cggcaaggac gtgaaactgg tcgagctcgg ctattcgatc 66361
gacggtgttg acggtcaggt gctcgcgcga ctttcgacgc cctctatcgc gcttggccgg 66421
gcctacacgg caacggcagc gggtgctgtg ccggcaagtc cgctttccat catgcagcgc 66481
aactgacgga gacagatatg gtccagtctc tgcggcttgg tgccgccaac gaggccgaag 66541
atcagaacgg catgcgccgt ctcaatcgcc tgccgatcat cgtcgccatc gtcatcgttg 66601
cgctgttcgt cggcttcgtc gtcatcggac tggcatggcg cggtcttccg ttcaaccgca 66661
acaatgatat ccacagcgca tcgaataccc cggcaacgaa tttcggcgac cagctcaagc 66721
gcggcgtcac cgacggtatc atcggcgagc cggtgaaacg ggaagcgttt cagccgacgc 66781
ccaccatgaa acagaaggtc gacaaggaac cgactgtcgt cgaccggcct acggaaccgg 66841
aagagcgacg cccgcggctc gaaaccgagg aagaatggaa ggcgcgcctg atgcgcgagc 66901
aggacgaaca aattatccgc gaggcccagc ggcagcggat ggcccggctg caggcacgag 66961
caacggcttt ggactcgccg ttgaaggtgg atatttccga aggcgagaaa gcacccaaga

Figure 3 (Cont.)

67021
actccacgga cacgggtcaa aatcccacgg cgacagaaaa caatgcctcg gacctctacc 67081
ccgccgccat gaaatcgggg atcatgggcg agaacctcga tccgaacgcc caggcgtcga 67141
aggaggattt cttcaaccag gacatcaagg atgatggcta cctcccaaat cgggtcgtgc 67201
cgcagatgtc ggtctatgag ttgaagcgcg gctcggtcat tcccgccacc ttgatcaccg 67261
gcctcaattc cgacctcccg ggtcgcatca cagcgcaggt cagccagaat gtctatgaca 67321
gcgccaccgg ctaccggttg cttatcccgc agggcgccaa actgttcggg cgctatgact 67381
caaaggtctc gtttggccag gagcgcgttc tcgtcgtctg gaccgatctc attttcccaa 67441
atggatcgac cctgcagatt ggcggtatgg ctggcacgga cgccgagggc tatggtggct 67501
tcaaggacag ggtcgaccgg catctctggc gcacttggag ttcggcagcg ctgatcgcgc 67561
tgattgggac cggaatcgac atgtcgatgc ccgagagctc gacgctggcg acacaggata 67621
ctgcctcaga cgccgtacgc cgaaacttcg ctgaatcgtt cggccgggtg gctgagcaga 67681
ccatatcgaa gaacctgaac gtccagccaa caatccgcat ccgacccggc tataagttca 67741
atgtcctcgt tgaccaggac atcatctttc cgtccgccta tcgtgacaat tagcggcgca 67801
gggcccacag atctgatctc cgtatctgcc gctggttggc gcgcggtgtg gcgctacaat

cactgcagcg caaaaccttt cctcacttgt actatttcta ggccgacgtg gcttgaaagc 67921
tgcatctcca caggtagtgc taatgtacac ggtccgaggg aatactccgc atgctctatt 67981
aacctgcggt tgccgcaaaa agtaattgtg tgcgtaaatc gcagtcatga cccgattgcc 68041
caaacggccg ctcgtttcgc aaaggacgag ctcggcggtc aagaagatag gagagatgtc 68101
cgtgaacgga aaccttcgct cgctcatcga tatgctggaa gccgcgcaag atgggcacat 68161
gatcaagatt gctcttagaa gcttcgcgca ttcctgcggg tatgacaggt tcgcctacct 68221
gcaaaaagac ggcacccagg ttaggacgtt ccattcctat cccggaccat gggaaagcat 68281
ctacctcggt agcgactatt tcaacatcga tcccgtgctg gcggaagcaa agcgccggcg 68341
ggacgttttt ttctggaccg ccgacgcttg gcctgcccga ggatcgtctc ctcttcggcg 68401
gtttcgtgac gaggcaatca gccacggcat tcgctgcggc gtcaccattc ccgtggaggg 68461
aagctacgga tccgcgatga tgctgacctt cgcatcgccg gaaaggaaag tggacatttc 68521
gggcgtgctc gatcccaaaa aggcagttca attgctgatg atggtgcact accaattgaa 68581
gatcattgcg gcgaaaacgg tgcttaatcc caagcaaatg ctgtcgccgc gcgagatgct 68641
ttgcctggtg tgggcttcga agggaaaaac tgcgtccgta accgccaacc tcactggaat 68701
caatgccaga accgtgcagc actatctcga taaagcacgt gcaaagcttg acgcggaatc

Figure 3 (Cont.)

68761
agtgccgcaa cttgttgcaa ttgccaagga tcgcggcctg gtctgagttc tagttgtcat 68821
cgtcgaaagg cacgtcgggc acaaagccaa gcgcgtccag aatgtccgat agctcctcct 68881
gttgggcctc cgacctcttc tggcgtgcaa cgtactcatc ctggagcgtc tggaggaccg 68941
gaccggaaat cgacggatcg tcgcttgcgc gcaaccactc ctcgtaaacg gcctgatcgg 69001
cccagaggag ccggcggtgt tcgcgaatcg cggaaactgc cagtgcctca agctctgact 69061
tggtcatgac actgtagcgc gcttctttct ccttgttttc gtcgttcacc tcggatgagc 69121
ccatatcgtt catccgcttc tccctgattt gatttcctca ctgcccagca cccaaggtcg 69181
gcattgtatc ggtctagccg ctacagccaa attctctggg ctgaggcaag gcagttgaat 69241
ctaaactcga catttaaaca actgcttcga gccgacgggc gttccgagcc gccgcgttta 69301
catactttag ttgataaact tatggtgtgt aaacgacgat ctttcagcgc atggatatgc 69361
gcaagctggt cggctctaat ttcgcccgcc tgcgtcggga gaagggcctg acacaggaag 69421
aggtcgaagc tcgttccggt ttcagccaac aatatctgag cagccttgag cgcgggcgac 69481
gcaaccctac cgtgattact ctttatgagc tggctcaagc cttgggtgta agtcacgtcg 69541
agttggttac cccgactgat gagactccgt ttggcacgcg atgaggcgaa taatcctact

Figure 3 (Cont.)

69601
gcagggtaaa atcgagcgta tgcgccgctt acatcccatt gatttcgcgt gtttgtgaac 69661
attgtgattc tgccagaagg ttttcggcaa gagctggaga tttgggatgg cggatggtga 69721
tggttgcaag gcgtcccatg cgaagagccg ttttgatgcg gctgttctca cgcagggtca 69781
gttcctccga tagaaggatg tcgattgctt ccagggctga gagttcgcca tgctcgaggc 69841
ggcggaccac gtggtcgagc gcctcgagag cacgcggcat cttgaggccg acgagatcgt 69901
gacggatgcg ttcgatcatc gacggcatag catcaagggc ggcgctcatc ggcgggtctc 69961
ccgagccata gccgttgcaa cagcgtcatg accatgccgt cacgcgagat tcgccgctcc 70021
agcttcagga ccgatcggaa cagggccagg ggaagtggcc atagatgaga tcgctcttcg 70081
gcgaaagcct cattgacgac gcgcaaggtc gtggcatgca ccctgggatt ggcgacggta 70141
tccagccaat ggcgcagctg cgcgttcagg tcatcaaggt tgcggaacga gcgagccagg 70201
aagaagtctt cgcgtatgta gcggaatggc ctctcgacct tggctttctt tcaagtccag 70261
gactgcagtt cgtactgaca ctcaagcgcg tatagaattc gaggtcacgc acccgttcca 70321
tcggtggcgc ggccagcgct tcgtgttgtc gacacgcaag cagagctggg gcgaggaccg 70381
cgtcaacgat acctgcaggg tctgcgcagg ttgatctgct gcgcgcactg atgggtggct

ataggagctg atgggtaact gtgagtccta agactgcaag ttgatatata agtccatata 70501
agtcagcgtt ttgatacggt tttgtatatc gacattgcat tgctctctaa ctccctatat 70561
attatcctgt atggttcgca tcctgcgata caggataatg atatggcata taaaacggag 70621
catataacgc agcagctgcg cgctgcgcgc gaagcgcaga aaatgagcca gcgcgagctg 70681
agcgcacgat cgggcctgac gcaaagccat atttctcaga tagaacgggg caccatggag 70741
cccggacttg gcagcctagt ggatgtggcg cgcgcgctcg acctcgagat agtccttgcc 70801
ccgaaaaaac tgatgccagc aatccgcaat atcctcgata gtgcatcggc atcgagtgat 70861
gtcctgacat ccgaccagcg caaactggtg ggcgccttg agcggtggtt tgcgcagcac 70921
aggggcgggt tcggtagtgc ttccgaggca gatacattca aagatagcct cgcgctctta 70981
cggcatcttc ctctgtcggc cgaggagatg gacacattca acgaggcgac tgcacgcctc 71041
gaccggtcgc aggctgatcc tccatcccgt caggaactga gcaggatcgc acatgccgta 71101
agacacctac gcaacgccgc ggtgcaccgc gaccgtgacg acgcggtccc tcgctcggcc 71161
tatgcgctgg atgaggaaga cgataatgcc taaggtcacg gtactcgatg tcaggctgta 71221
tggggaaccg gtttcgaccc tgacgaatct gcaggacggg cgcaccatct tcgcgttcaa 71281
cgaggcttat atcgaagacg aaaagcggcc gacgcttagc ctgtccctga aagacccgtt

Figure 3 (Cont.)

```
71341
cggggcgctc attacgaagt tcaggccgta caacatggtg gtcccgccct tcttctcgaa

71401
cctactgcca gaaggaccgc tgcgcaaata cctcgctgat cgtgcgggtg tgaagccgtc

71461
gcgtgaattc ctcctgctct ggatgctcgg ccgcgacctg cctggggctg tgacggtgca

71521
tccctccgaa ggggatgacg cgcctccgga tgacgagcag gctatcgtcg aagcgcggcc

71581
gaacgcgcta cgcttttcgc tggcaggtgt gcagctgaag ttctcggcct ttaagaacga

71641
caaaaagggc ggcggcttga ccattccggc cgagggcacg ggtggctcgt ggatcgtgaa

71701
gctgccgtct cagcaatata gcggcgtgcc cgagaatgag ttcgcgatga tgaccatcgc

71761
ccgcatgatg ggtatggacg tgcctgagct ccagctggtt gatctcgacg ccgtaagcgg

71821
cctgccgcag ggggtgggtg aactgcacgg gcaggcgctg gcgatcaagc gttttgaccg

71881
cacgccggag ggagcggtgc atatcgagga ctttgcgcaa gtcttcggcg tctttcccga

71941
ccacaaatac gataagggca attaccggat gatcggccgc gtgctgggga tcgaaaccag

72001
cacggccgac gtggcggaat tcatccggcg tctagtcttc agcacgctaa tcggcaatgg

72061
cgacatgcac ctgaagaact ggtcgctcat ctatcctgat cgccgcaccc ctgcgctctc

72121
gccagcgtat gacttgttgt cgactatccc ttatatcgag ggggaagata cggcggcgct
```

Figure 3 (Cont.)

72181
caatttctcc cgcacaaaaa agatggcggc gctgtccaag gacgagctgg cgcatctggc 72241
tgcgaaagcg gagctttccg aaaagctggt gatcgacacg gcgcgcgaga cggttgaacg 72301
ttttagggcg gtatgggagg cggaaaagaa aaatctgccg atggccgcca aggtcgccga 72361
cacgatcgat acgcacgcac cgacggtcga gctgtatcgt gagttcgcga agtagtgcct 72421
tgcggctcgg cattcaaatt atcgagcctt gctgtatatt caaggcgtta gcccatccaa 72481
agcatggccg ttggttcgaa tcccatcaag acccacaagg cggaaatggc acatcggccg 72541
cataagtcca aaaactccgg ccgacgaagt ccaggtcgag tagccagcct ctttcctgcg 72601
acatgacgct gacatcttga aggcccacca gatgaaagtc gctccgaaaa ccggggcgtc 72661
cggttacagt tctttggacc cgacgacgga ggtcatgatg cggggatcct ttaacgacct 72721
ggtctatgcg caaaatggcc gcactctcgt gaaggaaatc tgttccgtga gcaagcgatc 72781
gtcttcgtgg agcgaaagcg actcgacgcg gaggatctcg tcgcccgcat cacttggcag 72841
gcgttaagca aatgccttgt tggagagatg tatgtgaatg cggcgcgcga gacgtttttc 72901
cgcacggcga aaaacaaggg cctccttgcc gaaccggaga tgtcattgag ctcagttggc 72961
cggttggcta agtgactgag cttccgcttc caggaacgcg gacggcacgt gccttggagc

gggctcatcc acgcctggtc gatcaagatc gtttacgaca gcactggagc ggcggcttcg 73081
ttgcctttga cggtgtgcaa gccgaccaag gtcaatgtgg caagtggatg aatcagccat 73141
ttggagccga aggtaatagc cgcaccgttg ccttgtgttc gagatgattg aggacagaca 73201
tcagggcaag ggccatgccc acaacaacga cgccgatcgc cgcgccgagc ggccaatcga 73261
atgagacgcc catcaagttg atgaccacgc cggcgatcat gacgccctcg gcaccgccga 73321
ccaatgtagc agcaataaaa tcaccgaagc cgagagagaa ggtaatggtc gcaccagtga 73381
tgatacccgg aatggagatc ggcagaacga ttgaaaaatt tcccaatcgg tcgcacccgc 73441
ctccttgccc gcctcgatca gttcaggaac cggttcatgt agatgaccga gagcagcgag 73501
cttgcgaccc cacctagcgg cgtgccacgc gtgctgcttt tgccgccgct catgcgccgg 73561
ttcccgtcac cgtcccgctc ttcgaccggc gccttaccga ccgatcccga atggtcggga 73621
tgccgagcgg gcgctcaccg ccccccggct tcgggatcat cacccgtcgc accagctgtg 73681
gccggtagct cttcgagacg agttcctccc gcaggcccgc cagccaccct tccacgccct 73741
ccgcctcgat ttgcgcgaag gtcaccccgt ccacgcccgg cgaacccgca ttggcgcggg 73801
ccaacccata ggcatggcgc agcatgtcct cacggcagat ctggtcgtag agcacgtaga 73861
agcggaaagc gggctccgcc ttcgccttgc gatacagctt cctctgcagg ttcctgatct

Figure 3 (Cont.)

73921
ttcgggtgtt tcgagggtca tcgccaatca ccccctcctc accaacatcg aaagcacatc 73981
agaagtcagg gcccttccct ccaccggcat tacccggctt cagcggtatt atggccctgt 74041
ccgactcccg ttcgcaccgc cgcccttggc tgcgttgggt ctcccccgtt acccgcatca 74101
cccttccaac gtgccgtgcc caatacccgg gtggatcgaa cgggtgccca tgtcgattgc 74161
ttccccgttc acgcggcctt ccccgaatct caggcacgtc ggcatccaca tcatcacttt 74221
cgaggcctgc tcaggcttta ctcgcattac ggcccatcgg atcgctcaac cgcccaaggt 74281
ggcctttgtc acgaggcttc gacccggcta gttacccaac cgaaccggtc gctagctacc 74341
cctatcgaca actatctggg tggaaccttc ctccactggt gatacgcgcc atcggggcgc 74401
actgagagat tcgggttagg cctcacgttc cccgatgcg ggaaagatcg atccgcattg 74461
ctgccgatcc aacgctgtcg tttccctcag gccattcaga ggccgagtct tgagtatgac 74521
tatcgcggtc atccgaccgc aacacttctt ccgtcgcaac gctgccaccc ggatcaggag 74581
cctgaaacac gctcacgcct tcgaactcac ccgtcttcca tgcgtagaca gcatcctcga 74641
atatttgagg gatgacgtcg tcgctctcgg gattgccata cgacttggca acgatcctaa 74701
gaaccttggc aaacatcgag gttcccttgc gaaggttttc gcaggcgtcg acgaggtccg

Figure 3 (Cont.)

74761
gctgaaggtc tgctgcgttc ttcacgccga cgcccactgg aaactgtgtc aggccgacgc 74821
gaaccaccgc ctgacccaca tattgcctca cgattgccat cgcctcgccg gcggaagtcg 74881
ctttcggcac gaggatcaat cgtccacccg attcaactga aacggcgagc gggtccgtcg 74941
agccggcggc tgcgacgaac tgctcgacga tcgcgggctt gagagaagga tcggcgcatt 75001
ctttgattag ggcagcgtcg agcatgacgt ctcctcgggc ttcaggtgtt gaaggaaaga 75061
acaagcggtt tcgcgaacag ctttgcccaa gcgatcgcgt tgactcgctg aatcgcgacg 75121
atggatgtcc ctttggtcca ccatccgttt ccgactgcga cgatcaggtc cggctcgtag 75181
agcatcgatt gcaaagtggg ccagacgacg agctgctcgt aacaaatcag gggagcgacc 75241
cggctattgc ctacggtcac gacagggttg gcaaagaagt gcgcccgggc gccgtcgctc 75301
tcaccgagcc acgatcccca tggctgccac atggagcccg ggaccggcat tcgctcgcga 75361
tagaggaccc tgccgccatc ggccgagagg gtgaccaaca cattgtcgta tccggtcgcg 75421
tcgatcgccg ccgcgccgga gatgacggag atctccgtgc cctgcagagc cttgacccag 75481
agccgttcga aggtcggtgt ccagaagccc aaggcgcttt cgggcagaac tacattccgg 75541
acgccaccag atgcgcggtc cttcaccgtg gcaatcagat cacggtgacg ctgaatgctg

gtgttccggc cgagcgttga ccccagtttg agatcgacgc cctgccagct cgcaggtaat 75661
ttcgactcgg tccagtttgc ggcggaccaa agccaaaagc ctgtgaaggc gattgcgaca 75721
gccggccaca tgcgggttac gaggcccatg aggccggctg tcgtcgcgac cagtccccac 75781
catccccatc ccggaaagag aattcccgcg gccgtgacag gatgcgccca gccggtgatg 75841
cccattggcg gcacagccat aaggacagcc gccaggagat agcgaaacgg tcgacaatcc 75901
gaacgcttcg tccagagcac cgtatgcacg acaacaaagc tccccgaggc gcacagccac 75961
agcagcaagc ccggccacag atcggaggta tagaacgccg cgacgccttg cggcagcccg 76021
cgtgacgccg ccaggaagta tccagcggaa acgagtgccg ctaccctccg cgtgcgcgcg 76081
cgcgaccaaa gaattgggaa tgccagtgcg accggaagaa ggagggcata accgctccac 76141
ccgaccgttc cgactacaat tgaagcgatg gtcagcagtc tcggctggag gtgatcacgg 76201
cgcataggtc aggacttctt gcgccaggcc gagaatgccg gcggccggga tcggaccgaa 76261
ataacgggag tcataggagc ccgagaacgg cgagtgcagg aacacgtaat cggtcggcac 76321
gattccgccc gagaacggct tcatcggccg tccctgtccg tcgcgcagag caagagcgga 76381
cgaggggaca ggatgcccgt cgacgttgac gctgaccccc acctcgaccc gttgccctgc 76441
aactgcgatg accgacttga tgagcggcgc gatgccgccc gggcataggc cggcgcgcag

Figure 3 (Cont.)

76501
ataaccacgc attcgcgcct cccgcatggc cgaggttcga ggcggacaaa tgaagacgag 76561
atcgccgacg gcggatgggc gatcgatctt gacgatacgc cagagaccga gaggttcact 76621
cggcgtgaga ttgatccggt agccgccgaa ccaggcggcc gagatcgtgc cgaccgccgc 76681
cattgtcatc gtggctaacc cgaggaggag cggcttaccg cgtcgcctcc tcgaggtcaa 76741
ttcaacgaga ggaatgttca tttcagcgac agcccctggc tcttcgtctg ccgcagcgtc 76801
tcggcctgct ttagggcttc gatcgttcgc tcatgggcat tgagttgctg caccgtacgc 76861
atcgtgttcc aggccgattg gacctccgcc ttcgggcctg ggttcattcc agctgtgatc 76921
gtcttgaacg tttctccgtt cgtgtccttg gcggccagtg gcaggaaggc gcgctccccg 76981
aagcgctcgg tgaccgccct ggcaaagcct tccaattcgg ccttgacttg tctgtcggcg 77041
agagcaaact ccaacgccgc gggtaggtca ttgcggtcga tagcatcacg cacgcgctcc 77101
agcgtctgcc tggcgcccgg agacagcgcc ggaatctcga tcgccacctt gcggcggact 77161
gccagttcat cggcctgata gcactgttcg gcccggctgc gctggcgcat gtaatcgctg 77221
aggctctggg ccagagccgg tacatttcgt tcggcccgct cgcggtcctg cttgtcggca 77281
cggcttgcga gcaagccggt tttcctttc agcgaaccgt aggattccgg ctgattggcc

Figure 3 (Cont.)

77341
atgttcgata gcgcggactt cgcgacggtc tcgtccttca gcatcgcgtc gacattgacc 77401
gccttgaagg cgacttccgg ctgggtatag acgagatgga agcgggtcga gacatcctcc 77461
cattgcttct tcaaaccggg atcgacttcg agtctgtcag cgactgcctg ctccatcgat 77521
ttcgggaaag tcgcgatacc ggcaaccatg ggcctggtct ccttgaggtt ttgcgagttg 77581
gttgttttgg cgcccacggc gagaccgaac ctcgcgccga tggcgacgag ccgctgagtc 77641
agatcggcca gtttctgttt ctgccggacg gtccactcga gccggtcgcg ggcaatcgtg 77701
cgggcgacat tgacgaggtg catgccgcgg gcttcggcga agcgcagcgc ctgccggtag 77761
aaggttgcct tctcgtaatc gagcgtggtt tccttcgaat tcttctgcga caggatctgg 77821
atgaggccac cggacttcgc aaaggatcgg gcgccgtaat agaccccgag atcctcgcga 77881
tggcgggtca tcgcgacata ggtcagatgc cgatcgaggg agagcgaagc cagcaccttc 77941
acccggtcga cggtggcccc ctggctctta tggatggtcg tggcataacc gtgatcaaga 78001
ttgttgtaga agcggctctc gaccatgacc tgacgccgat gctcgacttc gccgatctcc 78061
gcgacgatgc ggttctgagc ggcctcgacg accttgccgc gcatgccgtt cttgacgccg 78121
agcgcgccct cgtttttcag gaagacgatc tggtcgccag gtgcgaagcg gcgatttcca

tcctccgcct tgaatgagaa accagcatcg acaatgccac gctcgacgag cttggcgcgc 78241
gccatctggt tgagcatgcg cacatcgcgc cgaaggtgcg cgaggatcaa tgtcgtcttc 78301
gtcggatcgt aatcccggtc ccagtccgcg atcagattct gaacagcttc agccttgagc 78361
tcggagcgca tcatcctgcc atttgcacga taggtatcga ctaccttgcc gacattgcca 78421
cgtgcgaggt cgagcgacgc atcgcacatc cactgttcgc gctggcgata gatggtctcc 78481
agttcggcat aaccgatccg atcggcaatg gcgcggaaag ctgcacccgc ttcgatcggc 78541
tgcagctgtt ccggatcgcc gaccaggacg agcttggcgc cggccttcgt cgccgtttcg 78601
acgaacagcg ccatctgccg cgatgacacc atgccggctt cgtccagcac gaagatcgtc 78661
ttgtcgtcga gctgctttcg gccttcgttc cagcgcagct cccaggacga caacgtgcga 78721
gacgcgattc ccgcttcctt ttccaaacct tcggcggcct tgcccgcaag cgcaccaccg 78781
acgacacgat agccggccgc ctcccatgct tcgcgcgcag ccttcatcat cgtcgtcttg 78841
ccggcgccgg cgcggccaat gacggcggcg atccgctcgg ctccggccac gtgctcgatc 78901
gccgtcttct gttcgtccga cagacgggaa tggcgactga acgccgcctc tagcacttcc 78961
ttccgaacgc catgcgagga tcgcctcgag agccagatcg ctcgggatcc catctccgct 79021
tcgagccgga tcagctcgcg cgtcgtgtat tttgctggcg cccggatgcc ggtcgcaaac

Figure 3 (Cont.)

79081
gcaatccgct cgcgttcgag acggagcgtt ttggggctct ggagaatgcg ggccatcagg 79141
ctatggaaga ccccggggtc gtcgatatag cgatgcagga tcttcgccac atcacgctcg 79201
tcgaagacgc tcttctcccg ggtgatcagg tcgaggacga tttccgggcg gcgctggatg 79261
cgtcgagcat tctcggcgcg tttctcctcc tgcagctcca gccgctcaag cgaaacggcc 79321
tggtcatcgg tcgtcgcttt ccgctcgatc gccttggtgc ctaccccgag atgaatggtc 79381
ggggtaagct cgatgccctg cttctcgaac gaacggccat cgatgcgaat gtcgagaccg 79441
gcaagtgcga gatgccggtt ctggcaggca aaccagccgt cgcgaaacgc attgaagtcg 79501
tccaggcttc cggcccacag ttcatagacg atcttgccgg catcgttgcg gagcgaattg 79561
ccgtccggcc caacaaccgc aagtttcttg gccccgaacc catcagcagt cagcggcctc 79621
aacgtcgtca tcagatggac atgcgggttg cccggtgcat cgtgatagac ccagtccgcc 79681
accatcccct tggcggtgac atgccgctcg acgaagtcac gcaccagcac gatgttctgc 79741
tcggttgtca actcgatcgg caacgcgatc gtgacatcct tggcgagttg cgcgtcggag 79801
cgcttttcga aatcctcgac cttgttccag aaggcttccg aggcgctggc gaccgagcga 79861
tcggcgatca tcgaccgcaa ccactcgggt gattcggctg gaatgacgaa ctcttcgtga

Figure 3 (Cont.)

79921
agaagaccct gcttggcgcg atagtcgatc gtccgggctt cccgctcata gtccatcctg 79981
gcgcagtgcc gataggccgc cgacagcacg gcgctgcggc cggagccgcg ggcgacgacg 80041
ctgacggaga aatgaggaac ggccacggca gagtcttccc gattgcacac gaaatcaatg 80101
ggttcgtcgg gagcggtggc cccgccaggg ccgcaaaaca ggatgtcgcg acagcgacgt 80161
ataattgcgc ccttggaagc cgctccttcg gaacggccgg gatcattcac caaagcatcg 80221
cccttggcga ttgtaggatt cacagtagtg cgttccgcac tccgctccga aaaactggct 80281
tcgaaagaca agctttctca gccacggaga cggacggaat gaagaaacct gcctcgaaaa 80341
ttcgcgacga aatcgccaag cttcaggaac agctcagaca agcggaaacc cgcgaagccg 80401
agcgaattgg ccggattgcg ctgaaggcag gacttggcgg aatcgaggtg gaggaagccg 80461
agcttcaggc agccttcgaa agcctggcaa aacgctttcg cggaggccaa gggggagcga 80521
acggggcttc gagcggaggg aaaaagccag atgggaatgc cacggccggc gcatcggccg 80581
cggcggtcgg gtctggcgcg gctcagggcg gcaatggcga ggcttgagcg gatggcgagg 80641
tcagcgacat ccgacgcccg caaaaaggac acgcgggaga agatcgaact cggcggcctg 80701
atcgtgaagg cgggcttgcg atacgagaag cgagtgctcc tgctcggggc gctggtcgac

ctcagccgcc gtctcaattc cgacgaaagc gagcgcgccc ggttgatcgc gatcggtgcg 80821
gaggcattcg gcgatgacgg tgaataggat cgcactcgtc gtcgcccctg tcgtgctgat 80881
ggttttgacc gtcatcggca tgagcgggat cgagcaatgc ctgtcgacct tcggcaagac 80941
tgacgctgca aggctggctc tcggccggat cggcatcgcc ttcccctatg tcaccgccgc 81001
agcgatcgcg gtgatcttcc tgttcgcgag cgcggggtcg gcgatcatca agttggccgg 81061
ctggggcgcg ttggcgggaa gcgcggcaac gatgttgatc gcgacgatgc gcgaggcgtc 81121
acgccttgcc gcattcgcag cgcaggtgcc ggcgggcaag tccattgcct cgtatcttga 81181
tcatgcaacg ctaatcggcg cgacggcggc gttgatgtcg ggatgtttct cgctgcgcgt 81241
cgcgctgatc ggcaacgccg ccttcgcacg cgccgagccg agacgcatcc ggggaaaaag 81301
ggcgctgcac ggcgaagccg actggatgaa catgcaggac gcggcaaggc tcttctccga 81361
tgccggcggc gtcgtcatcg gcgagcgtta tcgtgttgac aaggacagca cggcggcgcg 81421
gtcttttcgg gccgatgatc ccgaaacctg gggcgccggc ggcaagtcgc cgctgctttg 81481
cttcgacggt tcgttcggat cctcgcacgg catcgtcttc gcgggttcgg gcggtttcaa 81541
gacgacgtcg gtgacaatcc cgacggcact caaatggggc ggagcgcttg tcgttctcga 81601
tccttccaac gaagtggccc cgatggtcta tgagcatcgc aaagcagccg cgcgcttcat

Figure 3 (Cont.)

81661
ccgcattctc gatccgaagg aaccggaaac aggattcaac gcgctcgact ggattggccg 81721
gttcggcgga acaaaggagg aagacatcgc ctcggtcgcg tcatggatca tgagcgacag 81781
cggcggcatg cgcggcgtgc gcgacgactt cttccgggca tcggcgctgc agctgctgac 81841
cgcgctgatt gccgacgtct gcctgtccgg ccacacggac aaagagaacc agaccttgcg 81901
gcaggttcgg gccaatctgg cggaaccgga gccgaaactg cgcgagcggc tgcagtcgat 81961
ctacgacaat tcaaattcgg atttcgtgaa agaaaatgtg gccgcgtacg tcaatatgac 82021
gccggaaacc ttctccggcg tctacgccaa tgcggtcaag gaaacccact ggctgtccta 82081
tccgaactac gccgcactcg tatccggttc gaccttctcg accgacgcgc ttgcggccgg 82141
tgaaaccgat gtgttcatca acatcgacct gaagacattg gagacccatg ccggtcttgc 82201
gcgtgtgatc atcggttcgt tccttaacgc catttacaat cgcgacggcg aggtaaaggg 82261
gagggcgctc ttctttctcg atgaggtcgc gcggctcggc tacatgcgga ttctggaaac 82321
cgcgcgtgat gccggtcgca agtatggcat catgctcacc atgatctacc agtcaatcgg 82381
ccagatgcgc gagacctatg gcggacgaga cgcggcgagc aaatggttcg agagcgcgag 82441
ctggatttcg tttgccgcga tcaacgatcc ggagacggcg gactatatct cgaggcgttg

Figure 3 (Cont.)

82501
cggcatgacc acggtcgaga tcgaccaggt cagccgcagt tttcaaacga agggatcctc 82561
aaggacgcgc tcgaagcaac tggccgctcg accgctgatc cagccacacg aagttctgcg 82621
catgcgcgcc gatgaacaga tcgtgtttac ggccggcaat gcgccgctcc gatgcggccg 82681
agcgatctgg ttccggcgcg aagacatgaa ggcttgcggc ggcgaaccgg tttcacaagg 82741
tcggaaagat gtctgaagcc cgcctgatcc agccggcgcg cagtgcaacg agcaaggcgg 82801
atccaggagc atgaagagta tcggagaaat cagcgtgagc gccgcccaac aggcgggatt 82861
tcgggcattc tcgtcgtgcg aggagcggga aacagggcag ccgcaggagc ctcaacatag 82921
tggcccgaag gggaggcggg aacgactgct ccccgcttct gcacacagtt ttgtctcctg 82981
actttagcca acacgtcaaa agcggacttg ctgtcggctt cgctttcgat ctgcggtgat 83041
ggccgccaca tcaactgcgt cgtcgatggc ggttctggtt cgagggcgaa aaaatccgca 83101
ttgccgattt cgacacacct gagtcgcgcc ctccgcgatg cgaggccgaa cggataaggg 83161
ggaggaggcg aacgcacgcc ttctcaccct gctcaacgcg gggacattct cgctttcaac 83221
cgggttacga gatgaggaca agtatgggcg caagctccgc acggtgacac gagcggggcg 83281
ctcgctgggg cagcacgctc gttcatgagg gccttgccag gcgctgggac ggtgtgcgac

acggctggtg tgactgagag gtcgcgagag aatcgtcacc cgacggggcg gggaccgcgg 83401
gcgggctccg tgagcgcagc gagtagagcc gtgcgccata ggcgtctcgc ccaacatgct 83461
ctttctcata acatcagcga tatgaatcga tccgtgccca ccgattcaca agtgtcgttg 83521
gacgcgatag tcgggatcag cgattctgat ctcatgatct cgcaacccta ccggctctat 83581
gtcgagcgcc tggatccctc gaggaatatg gcccgctact atgccatgtc gatcgaaccg 83641
aacctcttcg gcgacatctg cctgcttcgc aagtggggtc gcattggaac caagggacag 83701
atgatggtcc atcatttcgg ccaggaagag gatgcggtcc gattgtttct cgatctgctc 83761
cgacagaaac gaaaacgcgg ttatcgtccg cgaccttcct tgccgaagga aaaatggccc 83821
gccgaagcgg agcacgaaag cgctacatcc gcgccggttc cagatccgga aggacacttg 83881
gatttagatg aagaacggaa tcttgatggc gagctttaga ccgagctttc ccttccggaa 83941
ggaatggctg ctcacctttg ccgaggacgc ggagccgtcg gccggcgcga aatgttgcgg 84001
ggttccggca agaagccgat ccaacgcctg gcgaaggcgc cagccgcgac agcctcatcg 84061
aagacatcgg aatggcgcgc caccaccgct tatgggttcc tcccggccgg aggggacgtc 84121
cggcctcact cgccccggta cgaatctcag ggtgtgctat ctgacccggc tgatctcggt 84181
gagcgatttg cggcgcgcga tgaactcgcg gaggagggga aggaagaacg ctttgctgaa

Figure 3 (Cont.)

84241
ccgcccgatc ggcggctcgg gctcgatgta aaaggagcgg ccaacgatat aggtgttgaa 84301
ttcatcgaag atgatccaga ggcgcaggtc tgcatcgagg ccggcccgcc gcttctcgat 84361
ggccggaatt tcagccgcgc agcgagcctg ctcgggctgc ttggtggtga tcgggaaaaa 84421
cagaaccagg tcgtcatcag gtcgggcaag cctcacgccg acggcgactg gccgatactt 84481
ccgccgctct atctctcctt ttcgggcttg ccgcgcgcat aaatagggat aacggatgac 84541
cgtcgcggtc tggatgccat tatagctgct catcgattgg tctcgtcggt ttccccatag 84601
gcgtccaccg ccgcctcgaa ttcgttgagc agctcgcccg gcagggtttc gagtgtgccg 84661
actgaacggg catcgtattg ccgcatcagc cgttcgtagt cgtcgatgtt aaggaggacg 84721
aggcgcggct tgttgcgttg ggtgatcgtg accggatggc gcaacgcctc ggcgatgata 84781
tcgccggact tccgggatag atcgcttgtt gagtaggaac caccggggcg aggcatgttg 84841
atctccagat gtctttgccg gcgggcacca tagcatcaga accgacgcaa atccggcatt 84901
tacagtattg ttgtaaatgc tgtgtatttc cgcggtgaaa ggccccgcct ggcggcgagg 84961
ccttaatcga gagtatcagt cccggttggg gcgggaccag atgagctggt agccatcttc 85021
gccttcgact tccgtcagcg tcgcgtagat cggggccggg aagctcgggt cgtcgagctt

Figure 3 (Cont.)

85081
gaccgagagg tagtcacggt cctgctcgga gcgcttctgc caggcggcgc ctagttcgac 85141
ggcacctgcg taaatgcgga agtgcgggcc cttgtccgag ggattttcga tgcggccgat 85201
gcgagctttg acgttaaggg cgagggtgcg gattgagccg gtgaagccgt tttcggtaga 85261
ggtgaaggtg ccaatggtag ccattgtcat gttcctttcg ttgtttcggg ccgcgccctt 85321
cgcggcctcg atggctgtcg gaaagaccgg gggcgatcgg tccgcacctg aaaggccgaa 85381
acattgtgga gggcgggcag gaagaacttt gttgttccgt gaggaatgac ggcggagccg 85441
gcaggggaag aaagttctga agggccgttg cgggaagcca atcgaggcga agccgttctc 85501
cggtcaggca tgcctcatcg agcgccagaa gtgagcgccg caacaatgaa gagaaggaac 85561
atgggactgg ctacgctcgc gcctttcgat cgaatgtgtc caaacggctc ataggtgaaa 85621
ccgctccgga tgcctggtcg tttgccgcga gcacctccgt atggagcttc gcagacgcgt 85681
gatccggccg cggctccagt tcgggcgcga taccgagatc ggcgcgtagg aagcaactac 85741
caagctccgc gacatatcct gacagtcaag ccgtcagcag cgacggggcg acggatttct 85801
cccagtaaac ccctgtcaac agcgttgatc agccggcaca gcccgacagc ctggcgacgt 85861
ccttgtcgaa agccagcgcc acgagtttca gcccttcgac ggtggtgagg tacggaaaaa

```
tcgtgtccgc cagttcgtcg acggtgaggc cctgccggac cgccagcgtc gcggtctgga

85981
tgctgtcggc accctccggc gcgaggatgt gcgcgccgag taggcaacgg gttccagcgt

86041
cggcgacgag cttgatgagc cctcaggtat cgcgagcggc gagcgcgggg ggcacctggt

86101
cgagaccgat cgtcaagaca gggaccgcat ttcgctcggc gcgcgccgcg gcctcggtca

86161
gcccgacgct cgccatctgc ggatcggtga acacgatcgc cggcatggcg ctgttgtcgt

86221
agcacaggcc gtcgccgttg agggcgttcc tcgccgcgag cctggcgccg taggcggcca

86281
tgtagacgaa ctggtcgcgg ccggtgacgt cgccggcggc atagatgccg acccgggtgg

86341
tgcgcattcg gtcgtcgacg acgatgccgc cgttcagcga gacggcgatc ccatggtcgg

86401
cgaggccaag gccgtcgatg ttgggggtgc ggccggtcgc gatcagcacc tgatcggcgt

86461
cgatcgcaac gtcttggccg tcgcgcgtga cggtcagtag aacgccgccc tcgatcctgc

86521
ggatggcgcg gtaggcgatg ccggagacga cggtgataca ctcgtcctcg aaacccccgt

86581
cagcgccgcg ccgatctcgg gctcagcctc ggggagcagg cgcgaccggc agacgagcgt

86641
caccttgacg ccggcgcggg cgaacatctg ggcgagctct gcgccgatat agccagcgcc

86701
catgacgagc agcgaacgcg gcagttcctc gaggtcgagc gtggtcgtgc tggtcagata

86761
cggcacggtc tcgatgccgg gaatggcggg ggccgccgga cgtgcgccgg tggcgacgat
```

Figure 3 (Cont.)

86821
gatcctgccg gccggaatgc gcgtgccatt cacctcgaca ccgccgtcga tgaggcgcgc 86881
tggaccgacg cgataggcga tgccgttata gacggggagc aggtcgacat acttggcccg 86941
gcgcagatcg gaaaccagca tctccttctg atggacggtt ccacaccagt cggtcagttc 87001
ggcctcggcg gtgatgccgg caaagcgggc ggcggcgcgt gcattgtgca gcgtctcggc 87061
ggcgcggatc agggtcttcg acggcacgcg gccgacattg acgcaagtgc cgccgatggt 87121
gccgctgccg atgagcgcga cttgcgcgcc ctgatcggcg gccgtgatcg cggccgagaa 87181
gccggccgag ccggcgccaa ccacgacgag gtcataggca cctccattgc ggccgttggc 87241
cgggaagggc cggcttgcga ccgtcgcgct cttcgatgcc gcatcggacc ggcaaggctc 87301
ggcccgaaaa gcgcgcggcc ggcctcgagc ccttcctcga tcgacagccg gaagcccggc 87361
tcgtcggcgg aacgtctgtc gcgccaggcg gatagatgct cgtcagagca gaaaaacgcc 87421
gtcgtcgcgc agagcgctgc gcagccgcgt tcatagcgga cagtctgcca catgacgacc 87481
gtcgacggcg cgacctcggc cagcgcccgt cctcgctgcc gcgtggtgat ccggatcggc 87541
gcgccgcaat ggcggcattg cgaggcaata gcgatgtcac gattggtcat ggcgccgatg 87601
ccgagcgcgt cgacggtgca catggcgttg actacgtgtc cgtacagcgt cacccgatgg

Figure 3 (Cont.)

```
87661
cccgtctccc ggtcggtgaa gggataagcg ccgacgatct gctcgccgtc gagaacgacc

87721
agagcgcgcc ggcgaagttc tgcgagcaga ggccggatgg ccgccccgct gagttcggcg

87781
cgctccgcaa gcgcgctccg gcttggggct cgtccgtcct cggcatactt aaccagcgcg

87841
atgcgcacgc ggtccgccgc tgtatcatag ccgctccagc gcttgagcac atggtcggag

87901
ccgaccatgg ccggcagcgc gttccggact accggcgacg tgacgaccga ccagttggga

87961
aacgtcacgc ccggccgcac ggcaaagctc ggcggtgtcg cgggcacaga aatgacagcc

88021
ttgtcctggg gggaggatgc gcagcaattg tttatggctt catgctcgga cgacagcgcc

88081
tggtcgcagc cggtggcatt ctcggcgcgc tcgccgcctc gtcctgttgc atcattcccc

88141
ttgtcctgtt cagccttggc atcggcggcg aatcgccgac ctgaggcgca tggagcgcgt

88201
tctcaaatcc gtcgttgccc aatgcggcga cggcacgctc ccggagtgtc cgttgatcga

88261
aacgttgctc caggagcgaa ctgtcaactg atcgctgggg gcgcctatgc agcgccccgg

88321
acctcgttcc tctgagcgtc gctctgttgc gcgtgcatcc agtcggcgat ctgctgcgcc

88381
ttgctcgccg cagtgaagat ggcgcgctgg tcggagcgca gcgcctcgag ccaggaggcg

88441
atgtaccggg cgtggtcggg tctcgcctcg acgctgaggt tgagatcggc gcagatcatc

88501
```

gcgctcaaca actcgaccgt gcattcctcc atagcgtatg cggccgagcc gaagcgtccg 88561
gaaagatcgc ggtcgaggcg atgcttggcg ccggaagcgt ggccacattc atggagcaat 88621
acggcgtagt aggcgaccgc gtcgcggaag caggcgaact ccggcatctg cacatgatcg 88681
gtagacggac ggtaataggc ctgcgaaccg ccgtggcgga tgtcgatgcc gagggaagcg 88741
cagaaccgtt cggcccgctc gatccgctcg gcctcgggca gcaccggcat ctcgggcggc 88801
gtgtagccgt cgacctgggc gcagttgaat acggtgtagc cgcgggcgaa cagacgccgg 88861
gcgggctcgt gacgatcctc gtcgccgtgt tgggcgtccg ccgcgtcacg atcggtcgtc 88921
ttccagaaca cgaccaagtg accgcgctcg cccttgcgaa cctgagcgtc gagcgcctgc 88981
cattggcggt aggtgcccca gatgccggcg gcatagcctt cagcgtgcgc cgcagcccag 89041
agcgagagga tgttgacgcc gcgataagcc ttgcttgagg cgacgttgac gggcgtggtg 89101
atggccgatc cgtcgtgatg ccagggcatc cggtagtcgc tggcgcccgc ctcgatggcg 89161
gcgatgatct ggctggtgac ccgctcgtag atatcggtcg gggtctgggg ggtgcgatct 89221
gtggtcattg ctgcctcctt aagctcgccc tctccgtcga gggcgaggcg ccaggggcag 89281
acgcgggagg ccggcccgtc acaccctgtt ctcggtgctg gtgcggaaca gggttgatgg 89341
gctggcagcg tctgccacac ccgagccctg cctcgacggg cgagctaaag gaggcgcaga

Figure 3 (Cont.)

89401
tcatgatcgg cgcgcgcgga acagagcggt tagatgatgc gcggctctct cagccggcgt 89461
cgtctcgccg cgagcacttc aaggcgacaa ccctggcgtc aacagatcgg gccagctcct 89521
tccgcagccc cttcgatgac ggcatcccgc tcggcgatcg aagcctgcca cggcccgctc 89581
agcatcagga gccagactca gtccgaacct cgtctatgtt gatcaggacc accatcattc 89641
gctcgaggtc ctgctggagg atactgcgct gaagatggac gagtcgattc tcgttcaaca 89701
ggctcctggc ttcttgcgct gaacgggccc aggcgggccg atgtcttgcg gtgatgcagg 89761
catcaggacc agggtcggct ggcaaaacac tgtcagcggg cctttggcat cagttgcctg 89821
cttcaggcag gcggcagtgc cgggatcgaa gaagcagccg gccagcaccc gacatgcaat 89881
gttcgctcga ggctcgcgag cattgtgcgg agccgggcac ggtccgcaat catcgccgga 89941
agcgggccga gttctgccga tatgccgtca agcgtcttcg cttatgcgcg ttgccgcggg 90001
tacgggctgc gtcgcgccga cctggcgcag gatcatgcca tcctccgtga tggaaagaca 90061
atcacctcca ctcgaggtga gatcttattt ggatatagag atattggcct ttctgagcgc 90121
ttcctctatc gattttgctc caagcgcctc aagcgcacga gcaaggcttt gttcgacttc 90181
agggatacgt tttccctgaa tcagcgcgat ctcggcgaca gatctacctt cggacaccca

Figure 3 (Cont.)

90241
tcgaaggcaa gatttttcga tgggtgagag catggtttcc caaatccaac cgccagatta 90301
tgcactacgg accatcggtc tcggaaacca agagcatcgc cggcgaaagg atggcttaca 90361
ggcggccata tactcctacc gacttcttga tgagggatgg cgagcgcagt gaagcccaat 90421
gcctccccta tccggcgaga ccaccctccg ccacttagtc cacgtggagt tcagttcgag 90481
ttcggacctc agcagcagga aagcggcttc cgggaggaag ccgacctttc catgagagga 90541
tcccctctgc ctgcgcaggg tagtttaaag ccatacgcag cgccggctgc cacagcgcgc 90601
gcgtccgccg ccttgagcac tgttgatggt cagcgcgccg gctctcgccg aaaatgtcgc 90661
agcaatcgcg atggctgcgg aatgcaagga cgagtgacag tttcatgagc ttctcccaag 90721
tttgaagatg cacacctctt gcgtgggccc ctttgccact taattacatt gcgcaaatta 90781
atcttcgttg caacagattg ttcgaaccgt ttgtcctaag ccggacaaga atgttggtgg 90841
ccggccagga tttcgttagt tccggaccgc ggcgccgaca aatggtgcgg cgtaaggggc 90901
gcgccaattc ggcacggaac ttgctgcgag gatttcgttt aaagcagacg gcagcggcag 90961
atcttcggtg gattagccgg ccgtgggtga ttagcgctta gtatggcgtc atgaacaggc 91021
gtgtcacgtt gttttcatcg gggattgatc atgcgagtag cgctgatttc tacgtcaata

tttgccttat gttgttcgtc aaatgtcagg gcagaggcgg tgcttccagt gaacccgtca 91141
ccatatctgg tcggcgccat cacgagaaac atgtttagag tgccaaaacc tgaccaggac 91201
ttggttctac tatctgcgca ccgcggatct tgggaggtat atcccgagaa ctcagcctac 91261
gccttgcagg acgcctggaa ttcacagatt gaggccgtgg aggtcgatgc ccgctttacc 91321
gccgataagg aagtcattct atctcacgat tacaggatgg agcgcgagtc cactggaacc 91381
ggcttcttgt acgatcagaa ctactcgcaa gtacagcaag ccgatctacg cgaccgtcat 91441
gggcgcgtgt tcaaggactc gcgaggacgc aacgccaagt tcatgacgtt ttccgcggcg 91501
cttgatctgc tcgcgcagta cgtcacagat gatgggcatg gttatgtgat gatcatcgat 91561
gtgaaagggg cggttgacga tcaggatccc actgatccca tcgagctcac gcagcgttgc 91621
cttgatattc tcgcggccaa aaagaaccca aagctcagca aggctgtggt gtttaagctg 91681
aaggctaagg atgcggtgga tattggtacg tttctgaatc ggaccaccta cgatcccaac 91741
gtcatgggcg ggttgatcgt agttgaaaat ccggacgatc agaacgttaa ggattccaac 91801
tatgatcctc acgaagatac aatttacgat cagtggaatg tggcgccgtt ccccgtccag 91861
tttgaaatga accaattcta caagggtgac ggtcttcagg cgtatctcga ctatgtcgat 91921
caaaagcagg gcttcgccac ctatcatgaa agtaattatt atccggaggg cgtcgccaac

Figure 3 (Cont.)

91981
agcgcgggaa aatgttgttt tgagcataac accgatccca gatccgtcgc tcacggaggt 92041
atagtgccgg actatcgcgg cgaaccggaa atggcgatcg tcaatcgtac gaatctgatc 92101
accactgact ggcccgacgt ggttgccgac atgctgcgcc agttggggcg ccgcaacacc 92161
agcaaactga gccgctaagg taagacctac cgcttagagt ggaatcttcc aatgataact 92221
ggaaagacaa tctctctacc actctctgta atagcgtgtc ttggtgctgg cgcaagccaa 92281
gctgccgcat gcgccaatca gactgactgc cttaaaagcg cctcggcaaa agtgtctcag 92341
acactcaccc ccaaggtagt gcctgttttt ggcgattatc cgaagctgta tatacacgac 92401
tctgctgcga atgaggatta tacggtgcct gatactacaa agcaggaatt tgacttttat 92461
acgaataaga cttcatttaa cctcccgcgt cgctcttcaa tcgagacaag agagatcgcc 92521
tcgatcagcc cggccatggg gttcactgtc cttttggtcg aaaagacccg cgataatacg 92581
gtttccaatg gcggtagcac actctcgcta ttaagttcca attccaacga cgcttacttg 92641
tcattcgctt taggcgccaa gcccagctca agtgggcaaa agtggtcttt tgccaaaagc 92701
ttgcttcaag gcaacaaggc gcaaaccgca tattggcaga agccgtggga tatgaatctt 92761
ctgggaccaa caggcgactt ctccggaacc gagtggatct attacacctt cactccagac

Figure 3 (Cont.)

92821
ggcaaggttc gcatcgaccg tttcgcgccg tacacctatt ttctggcgtt taccgcttac 92881
cagtgggatg aggccgtgct tgacggtggc ttcccgcatt ttcccttcga caccggtacg 92941
ccgaccaacc ggccgcagtc cgtcactttc ggatccgtcg ggccatggct tattggcgct 93001
gctggtgcgc ccggacaaac cccgccgacg agcgagccaa tagaggcatt gcccggcttt 93061
gagggagcga caatattctc agcgcccttg tcgatgaagg aagttatagc ttaccagaat 93121
tcgctgaggg gaagttattt tctcgacgtg gacatgcttc cctgcaacag cggccagtac 93181
ctttccggtc gaattagtac tccctgcggt acaggtagtc ccggcaatcc gccaccgaac 93241
attaactctg tcgctcagca taggatcagc accaatacca atcgttaggt cgtggcaagc 93301
aaaactttgg ccttgcctca acgacgattg aaaagatttt caaggcaagg aggtcgatcc 93361
gatgaccagc aaactcgggc caggccgcga ctccggcttt gcccgccgga tgcttcgacc 93421
aatgctaatc agaagagctc gctgacgagc gccgcggagg tttgctgacg caccgcgaca 93481
cgggcctcag ggcattggct gcggatggtc tcctcaacct gccagagctt cgccatccgc 93541
tcgaccgtcg ctgttgcgac cttcgagcct tccgcgacag tgcgcagcgt ttcggcggtg 93601
gcgcgaaaga gcaggccgta gacgagcgcc ttgttctggt aggcgatcgc ggcgatggcc

tccggcagtg tgaagacgac atgaaagtac tgtgtgtcga gcaactcggc gcggcgatcc 93721
tccagccatt gcgcacgggc gagcgattgg cagcggggac aatgcctgtc acggcagcgg 93781
ttgaaggcga tgcgccggta gcccgcattg atcgcacgct tcgacgtgcc cgccgagcgc 93841
ggcggtgggg cacaactcga tcgccgtcat gacgcgacgc tgagcggtcg acagcgacgt 93901
gtgctgggca cgataggact cgccatagcg acggaatata tccgccactt ccggcctcga 93961
acggggcatg ggcgcgagtt cagaagtact gaggcttgga gggcggcggg gtgggcgctg 94021
gacgtggcaa aagctcgaag gggctttccg tagcgcagac cttgttggtg gcgatgcgca 94081
ggtagtgggc ggtggttgcg aggctgcggt gaccgagcag cggctgaatg gtgcgcacgt 94141
cggcgccggc ctccaggaga tggacgacga aggcatgccg caagctgtgc ggtgtcaccg 94201
gtttcgacaa gcgggagaga tcgtgtggct tcacgcaggc ttgcccaact gcataccgag 94261
taattgggtg accggcgcga tctccaggga agagccacgc ctctggccgc cacatcctcc 94321
aatagtcgcg aaggatctcg aggagcttgg gcgacagcat cacatagcgg tccttttggc 94381
ctttaccatg ctcgacacgc acaaccattc tctggctgtc gatatccgta ggcttcagct 94441
gcaccgcttc cgaaatgcgc aggccggcgg catagcacgt cgtcaggatg gcgtggtgtt 94501
tgacatcggc cacgcagcca agaaagtgct gtacttcatc gggactgagg atgatcggca

Figure 3 (Cont.)

94561
gcttttgcgg tttcttcgga agcggcaata cctcttcagg cgcccagtcc ctctcgagcg 94621
tgacgttgaa gaaaaagcgc aacgccgaaa gggcgatgtg gatcgagccg ggcgccaact 94681
tcttctcgtt ggccagatag acctgatagg tccgaatatc ctcgcggccg agcaagtccg 94741
gcgccttgcc gaagtgtcgg ggtcatgatg agctcctctg tctgatggga taggctgcca 94801
aacagccgtc tcatcctctc gcagttgggg ctcctactga atacatgacc tccttgccgc 94861
tccgcggtag cggagcgggt tagtccaacc ctatatatgt gtcggatgag attatgtggc 94921
ggcgtcgctc gcagttgctg cgtttcccgg ccgggtgccc gctcggccgc cacataatag 94981
ttccgtctca gatggcctcc agcaatcgca gcaaggcatc cttcggctgg aaccgagccg 95041
gctggctgcc ggcaacgccc gccttgtcca agccgcgccg catcatctcg acgtcggctg 95101
ccgcgtagcg atgcgtcgtg gccacctgcg cgtggcctag ccaggcctgg atggtcagca 95161
ggtccacacc ggattgcaga agcgtcatgg ccagcgtgtg acgcctatgt ttctgtcgac 95221
ataggcgcca ctatctaccc tgccggacta tgtcgggtag ctttgttcgc aacggtaaat 95281
ctctgaggga taaggatatt tcctacagag ccgctcaggg cacccgacat agtcaacccg 95341
gttcacaggc tgttcaagaa ccccaacaaa ttgtcatcgg gtcgaaagcg ggatgacttg

Figure 3 (Cont.)

95401
ccggaatatg gggaggtctt tgccaaggct gcctccttca tcgccaatgt cgcctcgaga 95461
taaatctgtg tggtctcgac ggattcatgg ccgaggcaca aggcgattac ggcccggtct 95521
acgcccgcct gcaggaggtc catggccatt gtgtgcctcg gcctctggca ctgggaaaca 95581
ggatactctg gtctccgcgc tgcggctcgt tcagcgagtt tctcaacact gcgattgtag 95641
acttggcgaa cggagtgcag cgttccccgc gcaggtgggc ccccgtgccg aagaacaggc 95701
ggttggtgtg aggcgaaatc gagcgacgcg cgagttgcgg gtaacgttcc gcagcggccg 95761
agaccgcaag ttcaaggcgc tgggtgacgt ccgaacgtgc catgcgccct ccgccccggt 95821
tcggaaacag gaagttctcc tcgcccgcgc agtccaaccg gcgtttccag ttccggatca 95881
ggttggcggt cgtacgccag agcggcacgc tgcggtcttt gcgccccttg ccatgcaggt 95941
gcgcgaccgc cgagccatcg acgacgacct cgccgacgcg cagaccgatg gcttcagaca 96001
cgcgggcgcc ggtgttatac atcatgctga acagcgcgcg tcccgctcac ccgcccaggt 96061
ccgcgcatac ggcgcgtcaa agatcgcctg catcatgatg atctcttgag acgtcgcggc 96121
gctccgacga ttatccgtga cacgtatcca aggtcgttca caatccagag aactgccgtc 96181
gcggcgccaa aaatcgccgc tccaatcgca cttgcaacga caattctggt cttgccgtcc

Figure 3 (Cont.)

96241
caaagttctc cgaattgtat caagtccgtt aagcgaaaga cggcgccctg aactaagtaa 96301
agcagcaaag tactttgacc aagctccacc gcaacaaggc gagctaatcg agtcgagcat 96361
agaaccctcc aacagtgaaa caaagattgc gccgccactg ctgcagcggc tgcagacccg 96421
gtgaacatca gcaagacctg tttagccgat tgtgcatcat gaactaaaac aagattgttg 96481
taagcgtaag tgtccctccc ccaatcaaga aagcacaggc aagccactgc ccagcatgag 96541
aacatcaaaa gagatttgtg acgtagcatg gtgttcgcct gctcctcgat cgtctgggca 96601
aacaagaacc ccaaacagaa gaacggatag gtatatctca gcaatggtac tatcgataat 96661
gtgataggca taagtgcgat cacaattgca gacgcgcaca ggatccattt cgataaaagg 96721
ttgaaagccg caaagagctt tgtgagaagg aaagaagcaa gtactgccca caagaaccaa 96781
tatgtgccaa ccaattcacg tgaaaagtcc agaagtccgg cagtcacgcc gctgaagtga 96841
aaaaacgcgg ctagcttggc tgtttcaata agtgcgcacc aaaacagcat tggaatcagt 96901
aattgaaccg cacgatcacc gacggcgcga caaaacgatg ttcgcagaat tgttccagaa 96961
gcaagatatc cacttatggc cataaagagg ggcatgtgaa acatatagat cgccttaaaa 97021
tacggcgaca accaaaagtt atctgtgttt cgatagatca ccaattgtaa tagatgaccc

aatactacca aaattatgag aatgcctttg acaaaatcaa aggttatatc gcgattgttc 97141
gcccctgcgg agcacgaacc gcgctccaca gggggactg cggcgtaccc catgaccagc 97201
tcctaaattt tcatccagcg acggttatgc attctcgaat agacgatcgg gagacttggg 97261
acaggagaaa atcagttgct gctcaacgtc cgtctgccac cggcgatgac atctgacttg 97321
gctccctgca gatccaccag ataatcaatc ttgtttagat taggccttcg gctcaactta 97381
gattgcttct tggatggtct actaactgcc ctcaatgaag tgaccttaca ggccggctct 97441
tccaatccgc tttcttatcc gctctttcaa aattggtgca atcaattgtt tggatgaacc 97501
gcatttacat gatggattga tatcggactt tctaaccgcc aacgagtccg ccgtgaagac 97561
gcgcttggcc gcaactgttc cggcacaaaa gatcgttcaa aatgtaaccc ggtatgagct 97621
cccacgtctc cggtgatcag cgggcgcgtg cgtagcggat cggcatccag tattggcgca 97681
tggcgtcgac ggccgctgga ataaaggcgt aggcgttacg gagaaagtcc ccggtctcgg 97741
agccccttcg tggcggttcg ggcagcggac ggccccgatc gtcgcgacag tgcagcagga 97801
tgggcagaag caggctgtga ttgacgttac cagcgtccag caacggcgcc cacgccggca 97861
acctgagccg cgtcgcggcg tagaatccct gacaccaggg gcacggatca acatcaccat 97921
gggtttgcgc cggtgcatcg gctcgaactg gtcgggcgcg gtcgtaagac gttgctgatg

Figure 3 (Cont.)

97981
tcgttatggc gcagcgcgac ggcgaagatc gctgcgaact ccggggtatc gccgtggttg 98041
aaagcatcgg catcgatggc gagcagcggg cagatccagt cgagcggact catcgacacc 98101
ggtccggcca cgatcgcggc aacgtagccg tcgagcatgg cgagactggt ggcgataggc 98161
tgccgatcaa cgcgagcctg cagccatcgc tcgagttcct caagcggcat cgcggcggcc 98221
gccatcgacg acgatgctga tgaatggcga tgtcggctta tgcggcggtc tgtgcgatgc 98281
gctcgcgggc cgccttccag ttccaggcga gcagctcgtg cagctgatgg tcgtcctggt 98341
catctccgac gaaatctatg aacatggcga gaggattggc gaagatcccc gaactccaat 98401
tcacccctcc ggacggtgcc ttctacgcct tcatcggcgt tggcaatctc attggtcgca 98461
agaccccgga cggaaccgtt ctcgctgatg atacagctat cgcagcctat ctcctcaacg 98521
aattcggtct gtccagcgtt ccgggtgctg ccttcggctc gccttcgttc atccgcctgt 98581
cgattgccgc ttcggacgcg gaactcgaaa gcgcgtgtga acgtctcgcc aagctggttg 98641
cgtcgcttag caaatagcac tcgaggacta aggattgcat ccgatgaaca gatacgaagt 98701
tgcccttgtc acaggggcct cgagcggtat tgggaaggca atcgcgcttg agcttgcctc 98761
ggccgggctc agggtccttg ctcttggcag ggaccgtgct gcgcttgacg agcttcactc

Figure 3 (Cont.)

98821
gaccgcgggc atcgtgcccg tcgtgttcga tctctctgac gtttccgaag tctatgggaa 98881
aatcgcgggg gaaaagatcg acgtgctggt gaacaacgcc ggattactca ccgcctcggc 98941
aagcctcgtc gacctgtctg aagacgatat tgacgcaatg atcgacatca acattcggtc 99001
ggtcttcaag ctgacgcggc atgtcctgaa gcagatgatc gaacgtcgcc gcggccatat 99061
ctttttcacc ggttcaagcg gcggccttgc ccctcatccc aactcttccg tttacggcgc 99121
gacgaaggcg gccgtcagcc tgttttcatc tgcactgcgc tgcgatctga tcggtctacc 99181
gatcagggtg acggagcttt ttcccggccg cgttgagacg aacctctatc ggacagcgct 99241
cggcaaagag ggcgcaaaga agaagctcta cgacgacaat gaggcgatcc agcccgaaca 99301
catggcgcga ctgctgcgta cggcgctgga gttgccggac ttcgtcgacg taacccgcct 99361
ggaagtgatg ccgacgggcc aagtagtcgg cggcgcccag atgtccaaac tttctcgtta 99421
actgcgaacc ttggaaggaa aagatcatgc agggtatgaa catcgccgtc gtcggtggtg 99481
cgagcggctt cggcctcgaa acggcaaagc tcatggtccg tgacggcgtg tcgaagatcg 99541
tcgtcatcga catcaatcag gagcgtcttg atgcagcgaa gggagagctg gccggaaaag 99601
gcaccgagat tttcacggtc gtccgcgaca tcgcacgggc agaaggcgcg cacgcttcct

tcgacgctgc ggtcaagacc gcagggcgca tccgctcgtc aatttgcgca gcgatctatc 99721
cgcgcgcacc gctgctcgaa atcaccgacg atatgtggga cgctgaaaat gctatcaaca 99781
tcaagggcac ctatcacatg atggtggcgg cggtgaagca catgcagggc cacaaggccg 99841
agggcgaagt ttccggacgc atcgtcaaca ttacctctgt cgacgctttc aaggcgcacc 99901
cgcagaacgc acactacgcc gcgaccaagg ccgcggtcgt cagcttgacc cggtcctttg 99961
cgcatgcgtt cgccaaggat caggttctga tcaactccgt cgcgccggcg ggcatggcga 100021
ccgaaaaagc caaatctctt ggcttcctcg gcgagcttgc cgcggccaat ccgttgggcc 100081
gggctgccga accagcagaa attgcagaat tcgtagtgat ggtcgcgggc ccgaagaata 100141
catacatgac cggtgaacaa gtgatcgtct tgggtggtta catctacgcc tgatggcgtt 100201
cgggtcgcgc ctggccttct ggcgcgaccc cataggaatc tagatagcaa gaaagtgaag 100261
gcggagacga tgggaaacgg cttacaggag cgaagcgggg gcctgatcct tgtccacgcc 100321
ctcaggatcc acggtgtgga acgcgtcttc ggcgtgcccg gcgagggcta cctggcggcg 100381
cttgacgcct tccacgatgc cgagcgtgcg atcgagttcg tcatttgccg gcaggagggc 100441
ggggcggcct atggcaaact caccggcaag ccaggcatct gcttcgtcac ccgtgggccc 100501
ggcgccacca atgcttccgt tggtgtgcat accgccttcc aggattcaac gccgatgctc

Figure 3 (Cont.)

100561
ctcttcatca gccaggtggc gcgtgaacag acggagcgcg aggcctttca ggagatcgac 100621
tatcgccgga tgttcggcca gatggcaaaa tgggtagtgg agatcgagga tgctgctcgc 100681
accccggaac tcgtcagcca ggcgttccat cgcgcccgcc aatggccggc cgggacccgt 100741
cgtcatcgcg ctgccggagg acatgttgac gaatcgcgtg acggtcgccg atacacccgc 100801
ttacaagcgc gtcgagacct atgccggtca gccgcaactc gatgagctga ccgaactgct 100861
agcgaaagcc aagcatccgt tggtcgtcgc cggtggtggc ggctggacgc agcaggctgt 100921
cgccgacctg cgttccttct cggaaggttt ctcactgccg gttgctgcct cgttccgctg 100981
tcaggactat ttcaacaata tacatgctaa ttatgccggt gacctcggca ttgcggccgg 101041
gccgaaactg attcgacaca tgaaggactg cgacctgctg atcgcaattg gcgcccgtct 101101
cggcgaaatg acgaccggcg cctattcgct cattgatatc ccggtgcgga agcagaccct 101161
ggtccatatt cacccgggcg cagaagagtt gggccgcgtt tatcacgcga ccctgccgat 101221
caatgccagc gccgtgggct tcctgtcgca ggcgaccggg ctcgaaccgg ctgttgcgcc 101281
agtctggggt gattggacga aggctgccga tgccgactat ctgaagaaac cgcaggtgcc 101341
cggccccgtc caaatgggcg aggtgatggc atggctgcgt gctcatctgc ctgacgatgc

Figure 3 (Cont.)

101401
cattctgacc atgggagccg ggaattacac tgcctgggcg catcgcttct accagtaccg 101461
cacgttccgc acccagctcg gccctaccaa cggctccatg ggctacggcg tgccggccgc 101521
gattgcggcc aaaattaccg cgccggcgag gacggtcgtg gcctttgccg gcgacggctg 101581
cttcctaatg aacggacagg agctggcgac ggccatgcaa tacgacgttc gcgtcatctt 101641
cctcgtcatc aataatggca tgtacggcac aatccgcatg caccaggagc ggagctatcg 101701
gggccgcgtt tgcggaacgc ggcccgcaat cccgacttcg ccgatcttgc ccgctcctac 101761
gggttgcaca gcgagactgt gaaggcgacc gaagatttcg tcgacgcctt tcgccgctcg 101821
gaagcctcgg gcaagccggc gctaatcgag atccgcatcg atccggaagc gctgacgccc 101881
aaccctgacg cagatccgtg aataggcaat cgcgtcgggg agatatcagc aagggcggcg 101941
gcgttactcc tccacttcgt ctagcattgc gcgaaagcga tccaggatgc gctaccagcg 102001
cccgctccga acgctggtag cgttcgaaca gctcagtgga gaaatgcccg gagcgatcct 102061
gcggcaaccg cagttccagt ttgccgaccc gcgtcatcag cgtccgaccg tagtagccgg 102121
agcggtagcc gagccgctct ggcgtgcgct cgcctttccc cgcccccagg gcctcgtcca 102181
tctccgcttc gagcacctcc tgcatgaccg cgcggactac ctcgcgcagc ccatccgggt

tcgaaagcag aatgtctttg accggagtgc tggcggtctt accttcaatc ttggtcatgg 102301
tagcgttcct cgtgagtgaa tcaggtgact tcgacatcac cagcctgcca tgaccgcccc 102361
tcgcagagaa tttgcagaac cttcggcaca ctaccgcggt gttcgtaccc gtgactacag 102421
tgttccgcgc aatgaaccta tcgttgctcc gaacgaaaca gtgcgaatcg ccgtgctgaa 102481
ggatcggtta gctgaccctt catttccccc cgagcctttt tgattattct ttcaggagag 102541
cgtaccgaag cacgcgaagg tcttcgtctt cgagtgagat ctccaggacc cgattgacga 102601
gattgtcgtc attgtcgagt tcgatcaacg cctgctcaaa cagctcgatc tgcatgtcga 102661
ggtccatgcc gggtggccgt taaggcagat cagcccggca tggatggcga cgtcggcata 102721
ttgccccttg gtgcccggct tgtcttttgg tccccggaaa tcgaccgaat tcttcgtgac 102781
aaacgtccag tcgccctcaa ggatgattgg tttaagctcc cagtccttca ggccgcccag 102841
tttcatccag acgacatggc ttgtttcgcc gtggcctttt tcgatagcca tttttgccag 102901
ttcaggactg agacactcat cgatgagaaa cttcatcccg tcttcctgcg acgggcgacg 102961
cgacgatctg agacgatgac cgagccttcg ggaaggtcgc cgaagacgcg gcgccggccg 103021
cgcaaggggt tcgcttccgc gtagattgag gcaagcctta tcttttccgc gtccaggcta 103081
ggccaggcct ccagcatgcg ctccaccgaa tgaccggcag ctacggatgc ggcaacatca

Figure 3 (Cont.)

103141
tagaccggaa cgcgggtgcc ccggacgaca ggcgtaccgc caaggatgtc gggcgaggat 103201
gtgacgatct ctcgtgctgc ggcaaggtcg tccagtcgtt cgctcgcacc tctcataaag 103261
ggcataagat cgatcgtcag aaactcgtgg tgcacggtcc agtcctcgcg caacagggcg 103321
gaccaaggga gcgtacgcgc tcttgccagt cgaccctctg ctatccggat ggcaaacagc 103381
cgctcttccg aggtgagacg gcgggcgctc tcgaaataga aggcgatgag ggagcaggcc 103441
ccggccagga catggcgacc gttgtcaagc gacacgaagg cttctggcag aatatgctca 103501
tcgatgacgc gattgacgtc gcgtaggctc acgcgcgaga cgacggcagc ctcgctcgcc 103561
ttcagcattt ccgcaactgc gggcatgtgg gcctccatat aatgctccga tccgtcggaa 103621
tatataatgt gcaggtggtc atatcaaggt cttgaagacg aatgggtagg catcgcctga 103681
tggtggggcg cgtgcgacac tcgatcgacc ggcgggaaga ggggtcgttt tcaccgcccc 103741
tgatccccgc gccgcaatcc aaatggcaat ggtgcttgct gttaaatatt ttgacggggt 103801
ttcttcaggc agccttcatt gtttccgatg cgctgccgct gttctcacca agatcgaacc 103861
ggtcgacgag ttgcatcagg tagtccgcct cgcccgacag cgtccagctc gcggcttgcg 103921
tctcctcggc catggccgcg ttgctttgcg tcagctgatc aagccgcgtg attgcaacgt

Figure 3 (Cont.)

103981
tcacctcggc gatcgacgaa gcctgctccc ggctcgacag cgcgattgct tcgatctggg 104041
tcgagatctc gaggatgtgc ttggagatat ccagcaacgc agcaccggtt tcggagacga 104101
ggccggcgcc cttggcgact tcggccgtgg agtttccgat taacgcggca atctcccgag 104161
cagccccggc ggaccgctgc gcgagttccc gcacctcctg cgcgaccacg gcaaaacctt 104221
tgccggcctc gccggcgcgc gccgcctcga tgcccgcgtt gagcgccagc agattgatct 104281
ggaatgcgat gtcgtcgatg acctcgatga tgtggccgat atggctggag gcggcctcaa 104341
tccgccccat ggccgcagtc gcattgccca cgaccacggt ggagcgatcg gcgtcttgct 104401
tggccttgga gaccgtattg tcggcattgg ccgcctggtc gcctgccctg cggatggtgg 104461
cgacgatctc atcaacgctt gcggctgttt cttcgagcga cgcggcctgc tgctcggtgc 104521
gaccggagag cgccttggcg ccctcggcca tctgacggcc gcttccctgg atgacggacg 104581
acgtcgtgcg gatgtcgagg agggtttgcc tgaggcccgc gacggcggcg ttgaaatcgg 104641
tgcgcagttt gtcaagcgcc ggggcgaagg gtgtctcgat cgttgaggtc agccggccct 104701
ttgccatggc gtcgagccca tctgccagtg cgtcgactgc gaaggcgatt tcctggtcgc 104761
ggcgcaactt ttccgcctcg tttcgctcac gctcggcatg ggcggcgacg cgctcctgct

cggaccgctg ttcgagcgcg atcctcgcct tcgcattggt cttgaagacg tcgagggcac 104881
gcgccatctc gccgatctcg tcggcgcggt tccggttagc gacagccgtg tcgagcaggc 104941
caccggccag attgcgcatc gtctgggtga tctccccgat cggccccttc agcgtgagca 105001
ccagcgccgc gccggaaacg agagcgatga tcacgcccag aaccatggcg ccgatggaca 105061
gcctattggc atcctggctc tggcgcccgg cggcgctccg ttgcaggtcg gcgaacagcg 105121
atatctgctc gccgatatgg tcgatctcgt cggcagcggc ctggaattgc tgtgtgcgct 105181
tgccggtggc gccgacaagt tcgacggcgg actgttcaat ccggtcgaag gaggttgcga 105241
gcttggtcga ctgctccccg gcgaagccga gatcgcccgc cgtggagctc agcgcaaaga 105301
gcgcgttgcg gcattgcgcg aggtgcattg ccaatgtcga ctgcttttct gcggaacggt 105361
cgagcatgaa ttcggcaagt gcgatgcgcg tcaggtagat ggcatcggtg agatgccgcg 105421
tgtcctgcat tacgagcccg gccttggcaa ccgaggcatc gagctcctcg aaagtcgtcg 105481
acacatgctg catcttcgcg gtcgccgccg cctccaacgg ctccttaagc gctttgagct 105541
cagcgaagac atccaggatt ttctctatgt tttccggcgg gcgcgccttg tcatccacca 105601
gcgcactcaa ggccctgacg ttggccgaaa aggccttgcc cagcggcttg gatttcttcg 105661
gcaacgcgat cggtagcagc ttctggtgaa tcttcaggtc gcccatggct gcggcgatcg

Figure 3 (Cont.)

105721
cccgatagcc ctcgccatcg tccttgcgcg cggcaaatgc atctctgagc gcaacgacaa 105781
agcttgtcgc agagaggatc ctttgcgcgt cacgcagttt ctccttggcg tcgtcttcct 105841
gcgtggagat cgacttgtcg aacgcggtgg cggcggtcaa gagatccgcc tgcgatgtcg 105901
agatgacccc caaggcctcc ttgatgccgg cttcgaggcg ggcttcatcg gcatgcagag 105961
cccaaaggtc gtccattcgg ccgttgatcg cagaaagcgc cgcggatgcg ctttcgagct 106021
ccgcccagcc ttcggccttc ggcgtcaggc gtgcgccggc agcgtcgagc gcggcgcgct 106081
gctcgtcgag cttgctgaag acgagcgccc ggttttcttc ggtcgtctgg tcgagaaagc 106141
cgatcattgc cgcatagaca tccttgaagc cgcgcagcga tgccgcgacg tcgttggata 106201
tcgccatgcg gctttgcaga agcccggatg cgagcatgcc agtcaccccg accgcgctga 106261
tgctcaggat gaagggcaac accagcagca tcaccttcgt tcggattttg aaacgcgaga 106321
ggaggcgatc gacccagccc atgagatgtc ccgaaatttt gttgaggtgg cagccgcgtg 106381
cagcgcagca tcacggcatc gataggcggc gagggataac aaatcgataa tgaagcggcg 106441
atcacatgca aatgtcacaa aacattcaca caagctaatt tgtattactt ttcaatcgac 106501
tgggggatac tgcaaaccgc gagcaatcct ttccgctatt gttggaacac cagtcggttc

Figure 3 (Cont.)

106561
gtcacgtcgc tgttgtttcc gtgctgtagt ttttcgccac agttgaagag gggctaccaa 106621
tggaaatctc caaatttgcg gacgaacaac tggccgatca gatcgccgca ggccgcgagg 106681
ctgtgcccga agttgatccc atacggttga ttgagcaggt cgtccatcgg gcgcgcgctg 106741
gggccggggt ggatttcgac gtctttgagt ccctgatcgg cgaaatcgat ctcgtcgaaa 106801
tcaactatct cgagcgtggt ttgatggcat caagggcggt gtgcaggatc aatgttccgg 106861
cacccgttgg cgacagtagc gactggggga cagggttctt gatcgggccg cggctcttgt 106921
tgaccaacaa tcacgtcatc gactccgctg aagacgctct caaggctacg gtcgaattcg 106981
gctacgaact cgacgccgaa gggcggctga aacgcacgac acgctttcgg ctttccccgc 107041
aagatggttt tgtaacgagc ccgagggatg cgctcgatta cacggtcgtt gcgatcgagg 107101
aaaacagcga ggatggcgcg acgccaatct ccgacttcgg tttcttgcgt ctcgacgcgc 107161
gcaccggaaa gacggaggtc ggccagtatg cgaccatcat tcaacatccc gatgccaaga 107221
cgaagcgcat ctcgctcaga gaaaacaagt tcgtcaaata tggggacgag gcggacccgg 107281
agcgcgacaa tttcctctgg tactcttccg atacggcaaa tggttcgtct ggcgcagccg 107341
tcttcacgga tgcctggcag gtcgtttgcc tgcatcacgc aggcgttcca gaccgaagga

tgatcgatgg caaggaacac tgggtgctga ccgacaagac aacggcgccc gctcgcatcg 107461
ccatcaatct gcccgtcgac aaagttcact ggctcgcgaa tgaaggcgtt cgcatttcca 107521
agctcatcgc cgacgttcaa gagagaattg cggcgccagg ctttgcccgt tccaccctgg 107581
tcgatgacct tgttgccgat gcgaccgggg tgaaagcctt tgccggcacg acgccaggcg 107641
agagcatcgt cggcccgccg ctcgtcgccg caccggccct caggcttgtt gccgccgagg 107701
cacgacgccg gccgacgcgg catacgcacc cggccaatta tttcgacgga cgcgaaggat 107761
atcgatcgga tttcctgccc gtcgaaatcc cgctgcccac actcggggtc aatgcattgc 107821
ggcatggttc gccggccaag gtcaccggtg cagccgacga cgtcctgcgc taccagcatt 107881
tctccgtggt cctgaatgcc aatcccaagc gcaagatggc cttctacacc gccgtgaaca 107941
tcgacggtgc ccgctggacg aacctggaac ggggaaatga cgtgtggttt tacgacccgc 108001
gcatccccga ggaactgcaa aacggcgacg aactctatgg cgacgagcct gtgccatcga 108061
agaactattt cgatcgcggt cacctcgtgc gccgcctcga tccggtttgg ggcgagatcc 108121
gcgttgccaa gcaggccaat gacgacacgt tccagtggac caattgctcg ccgcaatatt 108181
ggggcttcaa tcagggcgcc gatctctggc agggtctgga aaatttcctg ctctacaaca 108241
ccgacgacga gaatgttcag gcttcggtct tctccgggcc gctgtttcgc gcggacgatg

Figure 3 (Cont.)

108301
aagagcacag gggaattctg atcccgcagt ttttctggaa ggtcattgcg gtaaccgaca 108361
agaacgacag gctctatacc agcggctaca tggtcagtca gcaggactat gccctcgaca 108421
ttccgttcga acgactcccg gtcgggccga acagcacaaa acctggtcaa aatttccagg 108481
tcccggtggc aaagattatc gaagacaccg gtattgtctt tgcagacgag atcttgagcg 108541
ccgacgccta ttccggaccg tcaaccgggc gagcattgcg caccgtggcg gacatacagc 108601
atccccggcg ctgatcatgc aaagcggctc tttgccgcgg gctgcatcca aggtttgcgg 108661
gcgcatcgtg aagccaaacg tcgccagttg caccgccggc ccgttgatcg ccgttgagga 108721
tctgtcgccc tggacatcac gcggcctttg caaatctggc acgttcggga gggacattcg 108781
gtttctcgtc tgattgcccc cgttcacgtc tacggttgcg tgtcatagaa cagtcataaa 108841
cggaagcaag catgctgcga ttgccagcct tgccgcgggg ctatgaggtg aagggggacg 108901
atcgcttgcc atcaagccgc ttgcccgacc ggaggccgtc gccgtcttgc cgcgcaccat 108961
cgagcaagct atgagctatt ccgtcgacgt cgacgtcgac gtcgacgtcg atccggacgg 109021
gcggtacaca ttcaatattc tggatgagac gcacaggtat ccggcatgac gctctgctgg 109081
aaagatctat acaaacctgc tcacggcaac tgggtgtgca ctgaacggtg gcgttgcgaa

Figure 3 (Cont.)

109141
cgggcgaacc gtcatttgaa cgaataatcg tcgagccagc ggatcccctt agacccttaa 109201
actatttgtt cgttgactct tcgagcgccg cttattcgga agccgagttt tttgaacctt 109261
aaggcccgcg gagcggccga ggtttgcagc ggaggactcg cgcaaagatc aaaatccgca 109321
atccaatacg gtcaacgatc cattcttgac gggtttgccg ctcttgaggc ggatacatca 109381
cccgcgaaag cggcagcctg atcatcggct gccgtctcat taaggagctc ggcaagaagc 109441
accggacgct tgtcgcaaac gctcggtcgg gcacggatcg aactgcgcac gcacatccgc 109501
agcgccgcct tccagggcta tgtcgtcgtc tttcgctacg ttgatgaggg catttcgagg 109561
acaatttcct cgaggggcac agggatgccg gcacggtgtt ttcccaagag cggcctgtct 109621
ttggaagata tccgcgacgc tctcatcgat gcggccgact gggatttcgt ggtcagtcag 109681
gcccgttgaa ctcaacgcat tttccgctga caagtccggt actcaaggcg gcgggacaga 109741
ccggcaaggg ggtctgtcgg ctcgccgcat ggagtcaatc gcataaatat attcccccaa 109801
ataatccata aaaactatat tttctgtatt atactcctgt ggcttcctaa tgtctatccc 109861
gtgaatgcaa gcgagaccat ccgatgacca aaacgatacg cttcaacgct tttgaaatga 109921
actgcgtcgg ccatcagtcg ccggggctct ggcgccatcc gcgcgacagg tcgtggcagt

acaaggacct ggagtatcgg acggatctgg caaaggtgct cgagacgggc ttcttcgatt 110041
ccatctttat cgcggacgtg accgcctatt acgacgtcta caagggcaat ctcgacaatg 110101
ccctgctgca gggcgtgcag ataccggtca acgatccgct tcagctcgtc aacccgattg 110161
cgcttgcgac gaaccatctc ggcatcggcg tcacggcgtc gaccagcttc gagcatccct 110221
acaccttcgc gcgccggctt tcgacggccg atcaccacac caaggggcgt atcggctgga 110281
atatcgtcac gtcctatctt gaaagcggtg cgaagaacgt cgggcagggc ggattgcgtt 110341
cccatgacaa ccgctacgat gtggcatcgg atatctcgaa gtgctctaca agctcttcga 110401
aggaagttgg gaagaggggg cggtcgttcg cgacaaggag cgcgggatct tcgccgaccc 110461
gaccaagatt cacgaggtcg gtcacaaggg aaaatatttc gtgtaggaaa gggtgtcagg 110521
tcactgatgt ggtaattggt tccgccgggg tattccctgt cgcgactggg cgtgatccgg 110581
cacggcgcat ctcgatgaca agtctgaggg tcaaatagac ggacactgcg gtaaggatga 110641
cagcgagaac cggctcaacc aggggatcat aggtagggcc ccaatttgca agccgatatg 110701
tgtcgtccca gggaccggca ttgaccggtc ttgaccagat atctgcgcag ttcacgagcg 110761
cgttggatac gtgttggcag acctgcattc cgacaacgat gcgccacaag tggattgcag 110821
tgagaagggg caagcagatt aagacaacga acgcgatgcc ttggacccat tttcccggac

Figure 3 (Cont.)

110881
ggcttctggg ctcgatatca aggagcctaa acggaaaggc ctccgatgca gaaccggatg 110941
acctcttggc gtgatatacc gcgagaaaag gaaccagcca gaagaagagc gcgaagaagc 111001
gcattccatg aacagcatag gcttcgcgtg tcaattcgcc gtcaaactta agctcaatcg 111061
gcagtttgat aatcaacgcg aaatcagatt tttgcgtcga tccatggatg ttgatcatca 111121
cgactagcgt gaggatcgcc agcgttatcc atagctttct gagcgtttcc tgcgtcattc 111181
cggcccctga cacgttaagc cttgccgcag atgcggttca gttgttcctg ggcccaaccg 111241
cgcagcaccg gttgcaggag cccaagccct gacaggtatt cgcctacgtc acctgaaacg 111301
tcgaggtcca aagaggtaat gcgacacgct ccaacatcga cagtgacgtc tggtgtgaca 111361
gcacccttca ctgaaaaccg aataaatgct gcgtcgcttg tcgcgcaggt gacctccacc 111421
tttgatctaa ctcgaaaccc ttcaggtgct gagcaaatat cgatctgagt tgcctcaaat 111481
cgccgtgtac ggtttggacc ctcaggcaga gcctcgcaaa ccttgatctg ctcgatagcc 111541
gccttgattt ttgaccagtc aggtgtgttg agaagtgacc aacattcttc cgcttgaacc 111601
gttgaggttc ctatcaccag gatgagcatt ccgaataagg cgggcttcac cattggcacg 111661
atccccaagc cgcacataga agctgcgtta acacaacatg acgtcggata attttcaact

Figure 3 (Cont.)

111721
agctgttgaa agattatctc atagcgggtg cactttgttt gaggtttcga acccggcctt 111781
atgtgggtcc gatgcttgga tactaacgtc cgaagccaaa gacgatttcc tcgtcgtttt 111841
cacgcgctgc cacaggagaa gacttacgag ccgctggatc agctcctaag atcgtcagtg 111901
acgggtaacc cttccaatcc agttcgagtt gggcgtcaaa acccctcttc tgggccttcg 111961
cgaccagatt cttaggggcg cttgggtcgt atcccatggt cacgtcagcg agcggatggc 112021
gtagatattg aacgctttgc aacgcgagcg tcattgccgc aacaataaca gtacggtccg 112081
caaacaagct tccgtcgcga tcgtttgcca aacggaacgg accattcttt atcggcgtgt 112141
gccctggaac ggtgaaatat gcatagcgag aaacgccacg gagaaattcg cccgtcgtct 112201
ggtcgtcgtt tccggcgaac gtgggatcgc tgccgaccag tatgatatcg atgccgccgt 112261
cgccctcatc ggacctggaa acatatgcgc cttcgatgaa caagcccgat tggttatcga 112321
cctgcaggcc tggctgttca ccgaacatga tgaaagcctg tttcgctgga agcttgatgt 112381
cctgagcctc cgttttcccg caagtccagt tccatcagat cggcaccaat ccttgaaacg 112441
tcgaaaatgc aatcatctga cgctaggaca tgagctgcaa taggctctag gtgtgcaatg 112501
gtcagcaggc gttcgtcgcg ctcttccggc gacataccgc tgaactcttt cgaaacggcc

cagtggcgca tgatcgtttc ctggcggaat gtgttccgaa gctccgatgt tgccagagag 112621
cccgatatcg tcatgcccaa tgcatcgagc ctgcggcgga agaccgcctc gaacatggtc 112681
gcgcggcacg gatgaggata tcgcattgtt tttgatcccg gatgcattca cacccagcct 112741
gatcaaaatc tctgcaagca agaagctcgg ttcggtgtgg gcagtttata acaggaatga 112801
agcccaggca tttgaaatga tgtccccagc aatcttgcca ccttcgtcaa tttgcagatc 112861
gagacctgtc actgtgaagc cagtatcctc ggcccattcg acgatggcgt ttttgcaacc 112921
tcgaaatcgg ggacagagtt tcgttttgaa agttcggggg aaatcaccta catagcccca 112981
aaaacctcag ccctaccgct aggctgaagc ctgtctccta cgaacggcga tgatgaaccc 113041
gaagaatttg atcgcggtag gtgatgtgca cggaatggca caaaccttag aactccttct 113101
caatgaagct gaccgtcacg aaagtgggat gcaccgaaga gccggagaat ggggaccaaa 113161
gttcattgtt ggctcaaggt ctccgcgccc ctttgtccag ccaccgagca aggcgcattg 113221
cccagcgttc gattacccgc cgcgcaaggc ctcctgccag gttcggatga tgggctgcgt 113281
ggcagccgtc gcaaagagtg acaagatttg agggttcatc ggtcccgccc atagaccgag 113341
gcaatagatg atgcacatcg gccttcggcg gacgtcacct tagtcgagca cgacacgcat 113401
ctaaagtcat cacgcaggac aacgcggcgc gtttgcttcc agttatctgc cgggggctgt

Figure 3 (Cont.)

113461
ttggcggctt tcttcattgg gcgaagaatg ggggaaagtc gctgagaaag cgtaaccaat 113521
agcaccagtc acagctcatt cgaactgacc gcgagacagc gaaattaaaa tccccggagg 113581
ccagcatact ttcggcatcg tgatccccgg catcgattgc cagaaactta ttaatgattg 113641
acgcctttga aatgattaca acagcgcttt caacagctgc actttccgac gtcatcgcgg 113701
tatcgccggt gtagtagtac agctgaaata cacgcttctt gaagtcgtaa tatgttgata 113761
tttgagcaga atacagcatc attctgcggc tgatttccag atcactatgg cttgtttgct 113821
gcccacatga tcgctgatgt ggtcgaccac gccaaggtca tgggaaatga acagataaga 113881
gatgcccatc cgcgcctgca attcccacag aagatccaaa atctgtgcct ggatcggcgg 113941
cgatctgtga ccagtcgatc gaccgcgacg cgaagtgtcc gccagaaacg gcgcctgttt 114001
cagcacgcgg aagtgctgca tcttcgcggc gtattcgggg gtacaactgg ccagcttcgg 114061
cagaggcgtc tcctccaatc gcaggaatcg ttggttgcga caaccaacct gcaccggaac 114121
cgcgtgcttc ggttatgggt atgtcaatcc ggttcaagaa ccgcacccca gcaaaatcaa 114181
agacttaaat gcgcaggttc aaatcgcaaa agcttacccc gcaaccaaca tggctgagaa 114241
aaccgtttgt tgaatgggtc cggaactgcc gccacagttc cggaccacgg caacatcgct

Figure 3 (Cont.)

114301
tcagtgcgat gtgcccgaac cgcccacagg tggcgattca gctcagatta gaagtcgcgc 114361
tgcaggcgga cgaagccgct gacgaaatcc tccgtgtctg cgccgatgtc gcgacttgtg 114421
tactgcacgg aaacacgtga cgccaaccca gaggtgatct tgtagtcaac cgccagacca 114481
ccgcgccatt gatccgcatc gctgacgaag ccgtaatcac cccaataatg aagccccggg 114541
gtgatcgcga gcttttcggt ggcgttgtag cgatacgagg tggcgacggt ccactcggaa 114601
gcggcgaaat agacgttcgg gtcggatgcc cagacgccgg caatctggaa gacgcccggg 114661
ccgagttcgg ccgaaaccag cgcgcggatg gctccttcct cgacctcggt atcgtaaccg 114721
ccgagaaggt cgatcgagac gccgccgacc gtggccgaaa cgatgccctg cacgccgatg 114781
ccgtttgcct tcgtggtcgc cccttcgagc tcattgatgg caacgcctgc ctggaacgcg 114841
ccgccctcat agaggtaggc aatcgagttg aactcggtga tgttcgccag cgagtcagtt 114901
tcgccgttca ggcctttatc ccaccagctg tagaagaaac ccgccttgaa accgccgagc 114961
tggatatagg cctcgtcgag gttgatcagg ctgtcaccga cgtcgctgtc gttgtcagcg 115021
ttgaactcgc tggcgaagaa gccagtgagc gttccaagtt cggtgtcgct ctttgcgctg 115081
aaggcgatgt atgcgcgcga gaaggcgtcc cagtcggacg tgccctgggc cccccagcct

tggcgtttgt tgacctcatc cgggccaaac gagacctgga aacgagcgta accattgatc 115201
ttcaggcacg tttctgtgcc ggggatatag aaatagccga tgccgaaagc gtcgcagacg 115261
cgaacgtagt ccatcggttc cggctccgca gcgacgatcg cgtcagccgc ttgtgcacca 115321
gagactgctg caagggcaac gctggagccg agaagcacag tgctaaaatt cattctcatg 115381
cggtcgatct ctcttttggg ttgggcaagg gccggggcag gtcggtcctg aacttcaacg 115441
gcaccctcgc tcgcgctgcg gcgaaacggg ccgtcaatat tgacgggcag cgcgctacct 115501
ttaccaacga atatattcat attctaaagg tatatgaatt ccgtaaggcg acgaaatgaa 115561
agtggtagac attcgttgtt aacgcaacac gtaaatattg tcgcattttg tacagcgcaa 115621
aagactgggc aatgttacta atcatacaaa tagtttgtat gatggcgccg aattggcgcg 115681
taataaaact tgaaacaact tgacatataa gaaactgatg atagatatat atcgcccgat 115741
gagaagaggg ctcttcccga ctagcgccgc cagagcctcc agcctggcgg cgcatttcat 115801
ctcgacgcta tgggcgtttt cccaggcgct ctataccggt ggcgacacgg ctttcatggc 115861
cgtcggactt tgcctcgcag gataatgggg aaggatcgcc cgcctacagc gccgtgcgtc 115921
cttcaggacg cacaaaggcg ctgtaagtct tcgaatctac ccattgtgct ttccgaaaat 115981
cggttccgat tttcgggccg atgcgctagg gcaaaccgtc gagtgcggtc caggaatgtc

Figure 3 (Cont.)

116041
gggacgctgt ccgtttttag tggcagagcg ctccccgggg ccaagcgctg cttgggtctg 116101
tcgcccttgg actaggcctg ctcgacggag ccctcgttac gggtgaaacg aagggcggac 116161
gaggggctga gaccgtaggc gctcttatag agaaccgaga accggcccgg attggaaaac 116221
tgaagattca aggccagctc ggtaatgctg cccgcccggc cggccttgat ggcgccatgg 116281
gcggcggcga gcctatagtt gcagaggacg ctcatgggcg agcctcctcg ataggtgcgg 116341
aacatcctct ggagcgcccg cggcgtgcac cgggcagcgg cggcgaggtc ctcgatcgta 116401
acagggttgg tcaggttctc gcgcatgaac gcctcagctt taaggagctg tcttggtgcc 116461
gcaccgctgg ttccctgaca gaatgcctca gcgagattgt gcggcatcgt cgagaacaac 116521
tttacgaggg ccagctgctt gtacgccttt gccaacaaag gcatggcttt cgatgctgcc 116581
gagttgagat ccctttccgc ctgccggagc gtctgataca gaccttgaac gtcatcttga 116641
gaaaagcagg tagccggcaa tacgaactcg tgcacatagg gtctaccggt caggtcctcg 116701
aagcttcgcc tgagagccga ctcgggaata tggaaggcca accacgaact ttcagattgg 116761
atcgtcattc ggttgccggc acgttcgcgg gcgctcgcga catgattagg cgagatgctt 116821
agtgttttgc gtgtccgccg gtcggtgatt tcgatatgtc cggacagcac gaaatagaag

Figure 3 (Cont.)

116881
ctgatgagcc gcgtatcgcg cctggcaagc gcttgcagac agaccgaatg ctccgcgctt 116941
gccagccagg ctgacagaac tcgttgccgg tggtaggcga gcgagcaagc ctccggggtc 117001
tctgaggaga ccttccacct ccagttcggc tcgacagatc caagattggc gaggatcgtg 117061
tcgcgcgtat gggcgacgaa actgtctgtc cgcagtggct cgtctgtgct gggaagggtt 117121
gcgcaaaaaa gcacggtgtt ccagccgagg ctcggaaact tgtctaggag aggcagcgaa 117181
ccgcattgac gaaccaatgg ttccgccgcc gcgatcaggt tccagtcgag catcgaaaac 117241
agcgccaatg ggttgagagg cgggtagagc agaacggcta tcaaagcagc aatcgtccca 117301
gcgacgagca ggcacaggac cagcttgccg aacggcaagg gcatcacttg gtggctcgtt 117361
ttatcagcag agccatgacg cgcgtcaatc tgcactgctc tccatcctgt gcgatattcg 117421
atctgaaccc ggatcgaaga tgtgtttttc ggatagggat cgcgcgtcgg ctttggccgt 117481
tactctgaga tgctgcggag cggcaatgat ggcgactttc ccatctgcct cgaagagaat 117541
ggacgaaggc gcaccggctg cgcgacacaa gacatgtccg gccgcacaat cccaaagatg 117601
ggtgccgtgc tcgacatagc cggcaagccg acccgccgcg accatcgcaa gtgctgcggc 117661
acagcttcca aggcagacga tatgataacc gcgcgcctca aacgcggcct cgacttcgag

gcgatgggcg aggggccatg ttcggttgcg gcctatgcca aaggcgatcg gctgcgcccc 117781
gacaagcggc gaaaccgagc ctgtcccatg caatgggcca tccacagaag cccacaacag 117841
agtatcgagt gccggtagcg caacagcgcc gaggaccggc tccttgttgc ggacaaaagc 117901
gatagagacc gcccagagcg gtatgcccga caggaaattc gcggtcccat cgatcggatc 117961
gatcaaccaa tggtcaactt cggcatcgcc aagctgttcc tcgccgacga tcgcgtcggc 118021
ggggaactgg gcgtggatca gcctgcgggc aagactttcg gcgtcacgat cggctgcgct 118081
gacgtagtcg gcctcaccct tggtctcgat gacgatgtgg gaaagattgc caaaccgggc 118141
cagcgcgaag gctccaacct tgctggtgat gttccgaagc aaatcgagcc gagtgtcgag 118201
gtcgcttgtc aatttgccgc ccgatcccgc gccgacgcaa ccatctcttc aagccgcaga 118261
gcgatagcgt gtgcccgctg atagtaggac gactccgaca gcacgtagcg gtccatcggc 118321
gtctcgaagt tcaagggcgt cctgtaattt gttgccgcaa tggcttttgt gatcgcatcc 118381
cagtcaagcc tgccgtcgaa tggcagcaga tggtcgtcct ttgcgccgaa gttgtcatga 118441
atatgcgtgg cgatcagccg atcgccatgg cgctccagca ccgacagctt gccgggctcg 118501
atcagttccc aatggccgct gtcgtagcag acgccaacga agtcggaact gtagcggcta 118561
aagaggcggg catagagctt gaggtaattt tccgcatttg ccttgaccag ggtttcgacc

Figure 3 (Cont.)

118621
gcgatctgca cgttgcgttc gatgcaatgg gcctcgacgt cgtcgaagga tcggaacagg 118681
ggctcgaaca acaggttctc gttttcaacg ctgcggaacg tgtcgtcggt gatgtcgacg 118741
tggagcacga cattcggagc gccgagggcc gcagcgagat cgatacggtt ttttagaagc 118801
tccaccccgc tttgacgctg ccaatcgtgg tgagagagga agttcttgcg tgtctcctgc 118861
gcgaatggga caggtccggc atgggcgagc tcgctcaccg ggttgacgcc gttgctggca 118921
tgaacggagt gtgtttgcag gcccgcctcc gcaacgatgc ggcgggtgaa ctcgatttcg 118981
gcgtcggcaa gcatatagga gctgccggaa tcggggttcc agttgatatg cgtaaatccg 119041
gcttcacgga tcaggtcgag ggagtggcgg atgccctcgt cgtaccagcg ttcatgggtg 119101
ggccaatgcc agacggtgat gcaagtatcc atttcagtgt ccattcagag gttgctcgat 119161
tccggggtgc ggccgaggct caggcgctcg gcgatgagga tgacggccag cgagaaggcc 119221
atgatcaggg tcacgtagac gagactgacg gcggcctggt cgggatcggc cgaaactgcg 119281
ccatcgacga tggcgatcgg cagaggcttg ttgttgacgt tgtaaaggaa ggccgagagc 119341
gggtattccg ccagcagatt gttgaacttc atgccggcga ccaggattgc ggtcggcgcc 119401
acgagcggca ggacaacacg gcggagccga tacggccccg aggcgcccat tgcccgggcc

Figure 3 (Cont.)

119461
gcttcgtcga aggccggatc gatcccgatg aaggccgagc gcatgaagcg gaccatgagc 119521
ggcaggctga agatgacgta gccgatcggc aaaagccaat agctgccgag cagaacgaga 119581
ttgccgacga gcggattggg cgcatcgaaa gcaacgatca gccctacggc aagcagcatg 119641
gtggggatga tccaaggcag gacaaagcag atatccaggc ctcgcgtcag ccagttgcgc 119701
ttgcgcacca tgatcggcac ggcaaacaaa gtgatggcga ggccgacggc aaccgcgatc 119761
gagctcatca acatcgaatt gaagaagggg acaaaggccg cgccgccgcc cagcacccga 119821
gcgtagtttg ccagcgtgaa gctggaaggc aggacgtcga tgccgatgct cgaagccggg 119881
gcgaaggaga acagcacaat gagcgcgacc ggcatcaggt agatcgctgc cagcaaatag 119941
gccagcgcgg tcaccacgat acgggcaagc ggattgcgta tcgcccgcaa ctggatgcgt 120001
gttgtcgcct tagcgccggc cgtataggcg cccttggcct cgaaatactg cgacagcagg 120061
atcagcccca tgagcacaag ccccatcaac agcgccagca gcgccgccat gtctggccgg 120121
cgcaagctgt tcagcgtcag gaccatctgg ctcagcatgt ggaagtcccg gccgccgagc 120181
acctggggcg cggcaaagga acccatcgcc gtaatcagcg tgagcagcgt aaccgcgagc 120241
acggttggca ggatgaccgg caggacgacg caccgcagaa tcgtcatttc cgaggctccc

atgctacggg ccgcctcgat cgtcgaatag tcgacgcggc gcatggcggc gcgcagaaac 120361
aggaagtgaa agctggtcat cagaaaagtg tgggcgaaga gaaccccaaa ccagccgatg 120421
aaccaatcgc gcggcagcga cgggaagagc gcggccaaag cagcagtgat ggcaccgctc 120481
ggaccatagg tgaagttgta gccggcagcc gcaacgacgc cgccgaagac gagcggcgtg 120541
gagaaggcga ttttcagaaa gccacgcccc ggcacgcgaa aatactcgag caccgccacc 120601
tggaacatac cgacgatcgt gacggtgagg gtggtcgccg ccgtcatcca aaccgtgttc 120661
caaagcgctg cgcggacgcg gcgagagcgt gcgagttccg ataccgcatc aaacatggcc 120721
aaactgccga gcctgaacaa cgcggcctgc aaggcagcaa gcatcggaac gagaaggaag 120781
gtcagcacgg cccaggcaat cacgatcaag ccgagccagt aaaaaacacg gtccaggcgg 120841
gtggatcggc tcatccggtc acctcctgga acacatgcgc ggcgccgggg cgaattccga 120901
gcgagacggt actgccgggt tcaggaagct ggtcgccgat cagcattgcc gaaagcgcat 120961
gaccctcgac ctcgagatcg acgcggctat gggctccgag gaattcgacg tggttcactc 121021
gcgccggaac gccggcgacc gccccaagca ggacgtcttc atggcgcagg aagctgcggc 121081
ctttgacatc gtatcccagc aggcgcgccg cgagtggcgg agcaagttcg ttggagacgc 121141
cgatgaactc gcatatgaac ggagtcgccg gcttgcggta gagggtacga ccatcgccga

Figure 3 (Cont.)

121201
tctgctcgat cttgccgtga ttgagcacca cgatgaggtc ggacatggtc agcgcgtcct 121261
cctggtcgtg cgtgacgaag atggcggtaa agccgagctc cgactgaagg cgcttgattt 121321
ccttgcgcat cgcggcgcgc accttcgcat caagatttga caacggctcg tcgaagagca 121381
gcacgcgtga tcccgtgacg agcgcgcgag caatggcgac gcgctgttgc tggccgcccg 121441
acatgttcgc tggcttcttg tcgagctgat cggaaatacc ggccatctcg gcaacctcgc 121501
cgacgcgcct ttccacctcc gccttggact tcttcgccac gcgcagcgca aaggcgatgt 121561
tctcgaacgc cgacatcgtc ggaaacagcg cgtagttctg aaagacgatg ccgacgttgc 121621
ggcgctcggg cggaagggcg gtaatgtctt gcccctctag gagcaccctt ccgcccaaag 121681
ccgggagcaa cccggcaatg gtgcgcaaca cgctggattt tccgctcccc gacgggccga 121741
ggagcgacac gaacgccccg tcggccacgt cgaggttcag gtcacggaca acggtcatgc 121801
cagggaagcc gacgtcgagt ttgttgaggg acagaacgct gtcagccatg gctctagacc 121861
tccgatccat gcagagccgc gctcattgac ggatttcaag ctcgatcttc tgcagccagc 121921
tgtcgagctt tggagcgatt gcatcccaat cgatcggctg ggtgttgacg agcttggcat 121981
tcgcctgaac ggtggccggc gacttggcga gcgcttccgg caggacaggg acctggccga

Figure 3 (Cont.)

122041
acttggcggc gtatgcggcc atcacatcgg ccgatcccca ccagtcgacg aaggccttgg 122101
cctcatcgag ttgatcggtc ccggccatga tcgccacacc ttcggaaatc accggagtgc 122161
cgccgtcggt gtcgatcacc tggactttcg cgtcgaggtc atcggcccgc ttcaaagcgc 122221
cgccgagcca attcagatcg atggaggcgc gaccggactt gaacgcctcg agctgggaat 122281
ccgcatcgtt ggcgataatg ccctcagcat aaaacctgtc caggaaatcc catccctcat 122341
cggatacctc accatcggcg tcgaggaaac ggacgaggat gccggcaaga tacatgcggg 122401
tcgtctgggc cgccgtggag ccgatgacat atttgccctc ataatcgtcc ttcgtcagat 122461
ccagccagct tttcggcgcg tctgggtcgg ccagtcggtc ggggtagtac gcgagcacga 122521
tcggcgtctg ccagaacttg tggaccaggc cttccgcgtc cttatattgt gccggaaggt 122581
ccttggccca ggacggcgaa tagggctgga agaggccttc cttctttaag agggccatcg 122641
aggtgtctac catcccgaga acgacgtcgg cttgcgggtt gttctcctcg gcgatcaggc 122701
gatcgtagag ttcgccgccc cctgcgttca gtagcttaat ctcatgaccc gctgccttgg 122761
cctgttcagc gatccatgcc ccgcgctcac cgccttgcgg gctgtagacg gtcagtgtgt 122821
cggccagcgc tggaaaggcc gcggccacga cgatggcggc ggtcgcaaat gcaaatgcca

gtttcatgat gttctctccc ttatcgagcg acgcgctcct cttacgccgg ctccatgtca 122941
gtttaattac attgcgcaat ttaattttcc ttgcaatagc tttcctgaaa cttcgaccga 123001
tttgcggact ttgccatgcc tgttttgccc gagctctccc tcaatgaacg acgcctcgtc 123061
gagttgatct tcaagaacag gggcgtggct cgcatcgagt tggcgcagat gtccgggatg 123121
accggcgcca ccgtgacgcg tctggttgcg agtttgctgg atctcggcct gatcaccgag 123181
gaggcggatc gaagcggagc gcaaggccag ccacgccggt tgctgcagct ccaggcccgc 123241
cgtttctttg ccgccggcgt caccttttcg gtgacccgca tggaagtcgt cattatcgat 123301
ctcagcggct cgatcgtggc aacgagaagc gtggaggttc atacggcaag tccaatggaa 123361
gtggtggagg cggctcaggc tgccgtcgat gacatgctcg ccgccttatc catccagaag 123421
aacgaccttg tcggaattgg cgtttccgtt ccgggaaatt ttggcaccgc ctcgaacctg 123481
ttgaaagccc atcccttctt tcctgcgttc gaagacggcc aggcgatcga agcgttccgt 123541
gaggcgttcg acgtcccatg ccatgtcgaa aacgacggca cggctgccgc acttggcgaa 123601
tacgtgttcg cgggtgacaa cgtgctggat gatccgctgt tcttcatcca catcggccat 123661
ggcgtcggcg gcggcgcggt gatcgacggc agaccttatg gcggcgcgca cggcaatgct 123721
tgcctgccgg gtgtcctcta tccctacgat cagccgcggc cgtccgggca ggaccttctc

Figure 3 (Cont.)

123781
gcgacgttgc acgcggccgg tttccatctt cgagatttcg aggagatgga cgcgatgcct 123841
caggccgctc gctccaccgt tatcgaatgg atcacgcgcg ctggcgcgca gctccggcaa 123901
gccgtccgtg tcgcaacagc atttttcgat cccgcgcgta ttgtcgtagg tgggcggtta 123961
cccggcgatc tgaataaaag gcttgttgaa acgatcctgt ctgagccgat agaaggacca 124021
tcgcgaggtc tgccgaccgc tccggtttcc gtatctcgac ttggcattcg cgccggcgcc 124081
gttggtgccg gctgtgttcc gttcttcaga gcattttta cgggtgccgt cgccaatggt 124141
ggaagcgcct acctgaacgg tagacgacct tttcctcgga ctcccgccca atagttccgt 124201
gccggaacac gcaacgctac cacagcccca agctgtgcag ccggaagctg ttgcacatga 124261
ggccgactcg tcaggaaatc ccgcgcaaga catgtcgaga ccactgcaga cccgcccctt 124321
gagcagggag cttcacatgt ccgagctgag gatattctca tcgtcagacc aatcggcgcc 124381
ggcaggttat tcccttacag cgccgcgcgt cttatcggac gcgcaaaggt cgctgtagcg 124441
ctttgaattg ctgcatgttt ttccttgagc cgaggttgat tcaaagagac atgcagtaga 124501
gtgacctttg agcagcattc caacaggcga aggctgtcgc atgtctaact gtgtgtagca 124561
tctctaaaat gcttcactcc aaaaaattgg gacctcgatc ggggttccac cggcgcatca

Figure 3 (Cont.)

124621
ggacccttcc gaaaatcgtc agtttattga cagctaagcc ttgtagaaga ttcggcgctt 124681
ccgggatttt gcagccgccc tccatgattg cctgcttcgg cagtggtcgg tgatcaccgt 124741
cgattttgag agctcctgct tctcaaagca ctcggcgcaa tccttcatat tgttaccgag 124801
gagacaatat cgatgaatgt acaacggccc ggacttgccg tgggccccct tttcgagaat 124861
cccgaatcag aaagttcaga accagggtct ccggccgccg ccgcacgttg ggtcgaagcc 124921
tctacggagg cggaggcgtc cgccgcctcc tcgtcgcaag gccagatcgt ggcagccccg 124981
accgccgaag aacggccatg ggagggtcgt ccgcaagagg cggtaagtcg aacgagggcc 125041
tggcgggagg cgggcgatgt cgatgagccg ctggatctgt cgttcctatc cctgaccccc 125101
ttgtccatcc ccctcgtatc cgggctccgg cgcctgaacg tcaacaacaa tcagctaggg 125161
gatctgccag acaccctccc gggaacgctt ctggagctgg aggccagcga gaaccggctg 125221
acccgcctgc ccgaccttcc tgccgggctc cagaggctga acgtcgaaaa caaccggctg 125281
accaatctcc ccgagcccct cccggccgcg ctcgagtggc tgggtgctgg ctacaaccag 125341
ctaacccgcc tgcccgagat gattcccccc gagcttatat ggctgggcgc cagaaacaat 125401
cagctgacca gcgtgcccga aagcctgctg acgcagctag gccaatggtc tagcattgat

ttggaaaata atccgctgcc gcatggggta caaacaaact tggtgacagc catgcatgcc 125521
gcgggttacg caggaccgca gatctttttg cctatgggac cggtggaact tgcacgacgg 125581
ccccttcacg aggttgtcgc ggattggctc gagggggatt tggaaacggt ggccgcctgg 125641
cggggcttcg ccaacgaaca aggtgcccgg gattatgcac atttcctcga ccggctccgt 125701
accaccgtga actatggcaa tgatgcgttc cggcaggcgg tggccatagg tctgcggcag 125761
gcagtggcca ggccgcaatt gcgcgcacag tattttgagc aggcttccgg agctagcgat 125821
agctgtgagg atcgcattac tttgacctgg aatggaatgc agaccgcact tctgatcgct 125881
gatgtagagg acggggtcta tgacgggtcg ctccaccagc ttctccagca cggccgtgtc 125941
atgttccgtt tggaggcact ggacgggatc gcgcgcgaga cggtcaactc gcttcgacgt 126001
accgatccgg acgccgacat cgacgagatc gaggtctatc ttgcctacca gacacagctg 126061
cgcgacaccc tggagctgcg gcacgtcgcc ccagacatgc gcttcttgaa cgtctctcac 126121
gttaccgagg aggacgttgc cagagctgcc agttccgtgc gggaacttga ggcgagggga 126181
ttcggcgagt atgtggcaac gcgctggcaa ccttgggaaa gagtcatgag gcgcatcgcc 126241
cccgcaagcc atgcagcgat gcaggagcag ctcatcgaag cgatgggaga ggagttcaga 126301
agccgcttgg acgaaaagct cgccgagcac ggcctgacgg gtgatgccga tgccgaacgg

Figure 3 (Cont.)

126361
gtattcggag ccgagatcct caacgacatc gcccgcagga tcaaaggcga gacaatggag 126421
aaggtgcttc ggggtcgcgg tcttgagctg tgaagcggcc gtccatgcgg tggctgtcaa 126481
ttgctgttcc tgcggcggtc gcccgcgtct attgcgcgac cgagatcagg ttatgccagg 126541
ccggtagcaa cggcgccagc gacggtgaat tggtgcgcgt gggaaaccac caaagccgtt 126601
ctggccggga cggacattgc aggtgttgcg ggcgtcacgg aatgcgtttt caaatgaaaa 126661
gctcgagtca ttgtagtttt ctaactcccg ccattagacc gcccgcccac tcgccggccg 126721
tccctgccca gtcggtacca ttcaaggata cggtttacga ccatcgagtg gcgcagatcg 126781
tgaacgcgtg ggccggcttt gcctttcaac ccggcacgac gtatgacgtc tgtaagcaac 126841
caggtgatcc ttcctggcgt ggagcgggaa ctgccttgtt cgtgccagaa cagggcggag 126901
tgaggagcct gctatgcgcc gacccgacgc cgtgcaacga tataggtccg aagctaacca 126961
ctacactgtc gggaagcggc aggatccggg tcttgaagaa ctttgtttgc cgaaccgtga 127021
tggtgccgtc gccgaggtta acgtcaccaa gatcaagtct ggccaattcg cctcgccgca 127081
gacccgcgca ataagccagc aacagcatgg tatacatgtt ctcctggcga agtgcagctc 127141
gcggcgatgg ataggatcgc gcaatgtcga gcatccgtct caagtcggca ggtgagtaga

Figure 3 (Cont.)

127201
tatggggctt tcgccattgc ctggccacct ccttccgggg tctcggatcc gaccggcgcg 127261
gagggaccga cgggtcacga tgccgtagga ttttcgcgaa ggcgcgctcg agtttttcgc 127321
gctcgtacgc atggttgcgc gtgcccttcg ttgccgccca ctgacacaca ctcagcggct 127381
cggtttccag ttacgggttc agctgcagga accgatcgaa ctgcaagaac aacaccggtt 127441
gcgacgtata cttgtatccc ctgcgacgca tcatcgcgac atgctcagcc atgatcccgc 127501
ccagcgctgc cgaacggttc gggctgacgc agttgggcaa gagcctgttc tggatcacat 127561
gatatcaatg cgcgccagac tggcatgcac tgtttgatgt ggcatgcctc acgcaaatct 127621
tcgacgggat tgtgatcaat cgcagccgct tccaagaagt ggtcgaggaa ccgatcgata 127681
atgcgggtcc gatgtagcag tgtcgtcgca gcccaacggt cagacgactg ccgcaaccag 127741
gccagtagca cctgttggtc gagtgcctcg tgacgttcga caacgtcctg gaagccatgc 127801
aggacttgac ggtaacaagt ccggcttttg atactgcgca gatcaaggct cgcgacatag 127861
cggccaatgt acgcgcgatc gggatcgggc caacgggcgg tcatgccgac acctccgttc 127921
ccggcaaatc aagagcgatg gccctgagat cctcggtcgc aagcttgagg tagggcgccg 127981
tcgacgcaat cgatcgatgc cccaacaact caccgatgat cttttgtggc accgcggcgc

gcaacagttc ggtcgcgcgc gcgtggcgga agatatgagg cccacgcttg ccccggggtt 128101
tgacgccagc gtcacgtagc cgccgtcgaa ccatgctgta tagcttgtcg agcttgcgat 128161
agggtgcacg cgtgcgaacg aagagttctc tcgcatctgt cgcgggccgt ccggaacgca 128221
gataaacaag gattgcttcg ccaaccggct ccgtcaaggg aaggagcgtg taggcttgcg 128281
ttttgctgtg acggacacga atggtttcgg tccgccaatc gatatcctca atccgcatgt 128341
tgcggatttc tcctgatcgc agtccgtagg tggcgagcag ttgtaatatc gcatggtccc 128401
gcaagccggc cggcgttttg tccctgctcg cacttaccag aaccgctgcg atttggtccc 128461
gctccaaaat ggaaggcacg ccttcatagg cgtaaagccg cggcgccaga acatgcggcg 128521
acaggtccgt tccaatgagc cttgtccgat ggagataacg cagcagcgag tgaagccgct 128581
acgctgcgca tttcagcgaa ctgcgcgtca gtttcgaggc aagcatgtcc acatagcggt 128641
cgatgtcgcc gacgctcact tccatgaggc cttcggctcc gcatcgttcc agttgccagc 128701
ccaggaagtg tctggcctcc cacaagaacg cgtcgatgct cgcccgagca agaccacgct 128761
cctcgcgaag ccaggtttcg tattcgttgc agatcgcaaa ccgcagtgcg tcggcggcgc 128821
aggttacttt tggagcaggt ggccaccgat cctgcacaag tcgcagcagt gcgtcacaga 128881
tatcgcgcta cctcggcttc ggtcacatct gcgaccagaa ttcctcgctg cattaaataa

Figure 3 (Cont.)

128941
tcgagaaact cctgtgcata ggcgcagtaa tttccgatca ccaccggact atatcggtga 129001
ctgctcagta tggctttgag ttcagtgatt agttctcgtt cagatttcga catcaatagc 129061
tcctctgctg gtcgaatgac cgcagaggtt cgctggaaaa taatacagag caaagacggc 129121
gacaaacagc agaattgtat tcattttctg cgccggtccc gcgctccttc gcattatggt 129181
cacctgatga ttagtcaaac gggggaagac ggatgcagcc gacgctgagg cgattagtga 129241
ggcagtgacg cgcaagacga tgcgcttcgt tccggtgaaa atcccccgaa cagcaggcgg 129301
cggcgatggt attgaagaca cgtgcccttc tggttcgtca gcaaactcag acaatcaacg 129361
cgctacgtgc tcacctgtcc gaactgagga tcattgccgg catcggcacg gtgaaaattg 129421
caagcctgat ctcgccgata aagacgagcc gcttcggatc gaagcggtct tgccaggcct 129481
tccagcgggc tctgcgccgt gcaatcccgc aacgattccg ataggaaatg atccgctctc 129541
gtttttccaa gtccggccct caacggaacc accggggccc tcaagccgat ctgttggaat 129601
gcattcgttc gcatattcca tggtttgaat aggccccata caaaaaatgg attttcccag 129661
tcttgccaca tggtgcatag cgaagctccc cacgcgtgcc tcgcctacgc cacctttcgt 129721
tggggcatga caccacgaca atagagaaag gctgatagat gaagaacgtc acatacctct

Figure 3 (Cont.)

129781
tggacccgga gtctttcgca ctattgggat tgccgacggt gtcggcctcg cgccgatctt 129841
tggtttgctc ggttttgccg cctagtgcag atgatccgct ttgacgattc gcatgcgcta 129901
ttcttagatg aagaagtacc gcgcgatggg gaacagcgtt cacggttttt gcctaggccg 129961
gtggaacacg aaggtaaggg cacttgtctg ccgcgcctgc cagacaatcg gaaccgaaaa 130021
cacggtccac cgctattgca cgcctcttac tgccgcccat gttgcaaatt taacccgaat 130081
tttcggaggt atatctcatg aatcgtagga ccgtgctgat gctcgcatgc accgcagcag 130141
tcgccacatg gctcgtagcc tcgccggacg tgcgggcgga ccccgttgcg gatatatgtt 130201
accttttttg cccagcggag caggatgaca ccgtcggcgc gttttgttca tctttttgct 130261
cctcatcttc gtcccttccg cttccaacgg accctcagag cggaagccag gtagagagtc 130321
aaaatccgac tcgaaccaca gacactgcga gccgaacgtc agagaagccg tgacaggagt 130381
agtacaattc aggccttggc ggatcgtctg ggtctcgaaa aaacgctctc cagttgcaga 130441
gccgctgtca aagatcggta acacgttagc gattgtttcg gcgagcgatg tggctcgacg 130501
cgcatcgcga tctggttggc ttaatggcgc gagacctgtg tcggcacagc ggtcaaggta 130561
accgggcgcc aaggcctgcc tgcggaggag gtcctgggct gcgctgctaa tgtcgcttgg

cacgtaaatg tgagaatgcg gctgtttcag ctgggcttag catttaaagc gggtcttcct 130681
cactttgtgt ggttcactcg ccgttagaca tcctgccgct atgggatgca aaccaaatcg 130741
aaatggtcgc ccggcccagg ggcaaaagtt ttgggtgtcg cgctcaccga tgatgacagt 130801
tgggttgttt gcgctgccgg accagcgttc ggcatttgcc ccccctgat tgcggacggc 130861
ggacccgaaa tcggccggct ggaccccaga agcctgcaag atctgccggt ccagggcaag 130921
accgtaacgg tgaagcttcg gttgagccgc tggcggtgcg cacatcagaa ctgtcagcga 130981
caaacgttca ccgactgact gccgacgatt gcttcccctt atgcgcgccg gacaaggagg 131041
gtctctgaga ttgtcggtct gctcggtcat agtgcaggcg ccgtcccggc gagcgcttga 131101
tgcgaaggct cggcatgccg tccgcgacga cacgatcctg cggcagctga agcgggatgc 131161
cgcgccgcgc tcgctcattg cgacgccgca agcgcgtcag gtggctgatc gattccatct 131221
ttatgcagat ctgcgggttg caatcgagga gcagatgagc ctttccggcc gtgccagggg 131281
acgagcattg ctgccggaca aaatcatcgg gaacgcgcaa gtcgatctga ttcaggatga 131341
tcctcacgtt gacgcaacgc atcggcgccg ggtgcgtcac ggtcatcgac aatcacggca 131401
ggtggtgttc gagactgtgc acgccttgcg caagaaaggt ctgtcctgtt cggcgatcgc 131461
acgtcgcacc ggctacggcc ggcgcagcat cgcaaaatgg ctgactttcg agacgccacc

Figure 3 (Cont.)

131521
cgaccgacgg aagtcggtgt tgaagccgac atcacccata aaagatggca atcgctgcgg 131581
acggcatctg tacacgatat caaacagcgc ggttacatcg gcagtttctc gaatctcgag 131641
cgacttctcg cagcctggcg ccgcgccgag aggtcgagca aggacagtgc gtcgccggct 131701
cctatcatac ccgatcaacc ggctcgcgat gttgtcccga tgcgggatcc ggagactggc 131761
cacgtgatct cgccggtggt cgcagctgcc ctctgcatga ggccgcgaag catgctgacg 131821
atcaatcagg cgagcaaggt ggacgccctg aagcagcgat cacatgagtt tgtcctgatg 131881
cgcagccttg ccatgcgatt tctggggcaa cggccaggca gaaggccaga tcgaccgcct 131941
gaagacgatc aaacgtgcaa tcgatggcag agcaggcgcg gagctcctga gagcacacat 132001
gctgccgctc gacaatactc atcaccacac agagtggccc cacacccttg aggagatggt 132061
ccttttacgc cgtgcatcac ggtttatcag gcaccggcta tgtgcgctac gacgaccgac 132121
ttaattatcg gcggcacgct tcggagctcg gcgagggaga cattcacttt ggcaagggcc 132181
aagacggcaa tgccattccg ctcagccgcc ggccagcatc cagcggatcg atagataagc 132241
accccgaaaa ctacctcgcc gcagtatacc cgtcgcctat ggatgtccta aataggagag 132301
ttcgtcagct tttcgaaagc tcagccgaat agcagtggga aggccaagac cgaccaacct

Figure 3 (Cont.)

132361
acctgaattc agaaatgggc ctccatccaa atttcgcaat gcattacttc aagcaaaatc 132421
tcgtgccgcg gaggcagtcg tcacctgagg cgttaaccga ccaagtggag ctctgcccca 132481
gcgagccaca taactcgcat gcagctcttc actgccgaaa ctcctcagac gccagtaaac 132541
cctgctaccc ggcaaggacg agtatctccc cgtgcggata cagggcggcc gaattgcttt 132601
atacgaatgc aaacgacatc tgcgccgggc cgactgcggg gtggctcctg aatctcaata 132661
acagcgcgcc gccccgaacg aacgcgctat ccgcggcgag gagtctgcac ctgcgcacca 132722
cagcgagaag ttcatgcgca ttttggtgac tggtggcgcc ggctttatcg gatcagcgct 132781
ggttcggtat ctcgtgagca tcaacgcgga ggtcctgaac gttgacaagt tgacctacgc 132841
tggcaacctc gcttcgctga agccggtcga aggtctccgc aactatcggt tccttcgcgc 132901
cgatatctgc gaccgagtgg cgataaacga agctttcgag acgtttcagc cggattacgt 132961
cattcatctg gcggcggaaa gtcacgtaga tcgctcgatc accggagcgg acgacttcgt 133021
ccagactaac gtgaacggaa ctttcacaat gctggagaca gcgcggcaat actggagcaa 133081
tctgtcccag aatcggaagg cattctttaa gatgctgcat gtgtcgaccg acgaggttta 133141
tggctcactt ggagaccgcg gtcagttcga ggaggtttca ccgtacgacc catcttctcc

ctactcggct tcaaaggcgg cgagcgacca ttttgcaacc gcatggcagc gaacatatgg 133261
gcttcccgtg gtcatttcga attgctccaa caactatgga ccgttccact tccccgagaa 133321
actgatcccg ctgatgattc tcaatgcatt ggataggaag cctttgcccg tctatgggac 133381
gggttccaac attcgcgatt ggctctatgt cgacgaccat gcccgagccc tttggctgat 133441
cgtcagggaa ggccgtcctg gtgagaaata caatgtcgga ggtcgcaacg agttgcgcaa 133501
tatcgacgtc gtcaaccgca tatgcttgct cctcgatgag cttagtccca acgcttcgca 133561
ctatggtgac ctaattactt tcgtgaaaga caggccgggt cacgacgcac gctacgccat 133621
tgacgccacg aagctcgaaa ccgagcttgg ctggaaggcg caggagaatt tcgataccgg 133681
catacgcaaa acggtggaat ggtatctgga aaatggctgg tggtggcaac cgctgcggga 133741
caaggtttat tccggtgagc gcctcggtct cctggagaaa gcgtgacaga tgcggctcgc 133801
ggtgaccggc aaaaacggac aaatcgccct cgctttgaag gcgcaggcgc gacctgacgt 133861
cgagatactt actttggggc ggccgaattt cgatctggct tgccgctcga ctgtcgcaag 133921
ctccatcagg gatgccgcac cggacataat tgtctctttg gccgcctata ccgccgtcga 133981
taaggccgaa agcgagccat acgaagcctt cgctgtgaac cgcgatggag tgcaggcact 134041
ggccgaggca gccgccgggc tcggtgtccc agttattcat ctttcgacag attacgtgtt

Figure 3 (Cont.)

134101
tgacggtgcg aagccggtgc cttactgcga ggaagaccgc acaggcccga tttcagttta 134161
tggcaggtcc aaacttgagg gtgaatttgc ggttgcctcc gccaacccaa atcatacgat 134221
cctgcgcact tcatgggtct attctcgata cggccaaaac ttcgtgaaga agatgctccg 134281
gctcgccgat acgaatgacg aattgaatgt cgtcgccgat cagctcggct gtccgacatc 134341
ggctgacgac atcagcgtcg ccgtcatgac gatagccaga cggatgctgt cgagctcatc 134401
ggctgatttg cgcgggatat tccacctgtc aggatcgggt gaggccagct gggcggcctt 134461
cgcgaaatac gtcttttccg tttacgacga gataaccggg cgccaaatca aagtccatga 134521
catatccgct gcagaatatc ccacaccggc tcgccgccca gcaaattcga ggctccactg 134581
cgacaagctt gagcgaacct ttggtatccg tctgccaaat tgggaggagt ccacgcgccg 134641
gctggtttgg gcgctgcttt tagaagggaa agatgcgtga agggaattat tctagcaggt 134701
ggcagcggta cgcgccttca cccgatgacg cttgtcatgt caaagcaaat cttacctgtc 134761
tacgacaagc cgatgatctt ttatccgctg accacgttaa tgttggccgg aatccgcgaa 134821
atcctcatca tctccacgcc gcaccacatg cctctcttcc aggcattgct gggggacggt 134881
tcgcaatggg ggatctcctt aagatatgct gttcagccca gcccgaacgg gctggcgcag

Figure 3 (Cont.)

134941
gcctatgtaa tcggtgccga tttcgtagct ggttcaccct cttgcctgat cctcggcgac 135001
aacatttatt tcggccacgg cttgcaggga cttttgcagc aagcggccgc cctccagcaa 135061
ggagccacaa tttttgccta tcatgtcaac gatccggagc gctatggcgt cgttgagttc 135121
gatgagggca tgaacgcgct ctcgatcgag gagaagcctg cggcaccgaa atcgacctgg 135181
gccgtcacgg gactttattt ctacgattcc gaagttgttg acatcgccgc caatctcaaa 135241
ccttcagcgc gtggcgaata tgaaatcacc gacgtcaaca gaatttatct agagcgtggg 135301
aaattgaagg ttgctgtttt ggggcgcggg tacgcttggc tcgatactgg tactcccgac 135361
agtttgctcg aggctgcaga gtttgtgcgc acactcgaga agcggcaagc attcaaagtt 135421
gcctgcccgg aggaagtcgc tctggcaatg ggcttcatct cagtagaaga atttgcgcga 135481
attgcggaga gggccggaaa gggagattac ggcgcctatc ttcggcggct tgcgtgaagc 135541
gccgcgtgat caagatggca acaagggcta gcgacatgca tcttctgaac gttccgctca 135601
gtcagccgca cttctttgac ccccacagtg cgtggctgcg acatggcccc tttgggatgt 135661
ggctggttca cgcgttgcgg ccgcggcgaa ttgtggaact gggcacgcat tacggctttt 135721
cctacttttg tttttgtcag gcggtggccg cgggtgatct ggcgactgag tgttttgcgg

tcgatacatg gcagggcgac gagcatgctg ggttttacgg cgaagagatc tatcatcgcg 135841
tgatggccca caatcagcaa tacgtcaggt tcagcaggct tttgcgcaag accttcaccg 135901
aggcgctgga cgacatcgag gacagttccg ttgatctgct gcatgttgat ggtcgccact 135961
tttaccacga cgtaaaagcg gatttcgaaa actggattcc taagctgtcg ccccgctcag 136021
ttgtgctgtt ccatgacact gaagtccgcg agcacgggtt cggtgtttgg caatactggg 136081
cggaactcgc agccatccgt ccatcgttga acttccccta tcagcatggg ctgggaatgc 136141
tgttctgggg caaagaaatt gcggaggggc tcgcgccatt ggcgcggacg cttaccgaca 136201
cagaacggct caattggccg gtcgagtact ttgccttggc aggtgaaagc tatgtgcgcg 136261
acgccacgca acggggagtc ataaaaaggt tagaattggc ggaagcgacc atcgaggagc 136321
gtaaagccga gaccgtgttg gtgcaacaga agctgcagga agcgcgccgc cgaccgctca 136381
aacaattaaa acgcaagctg gttttcaaca tgttgcgtgc agctgcgaag gctagcccgc 136441
cgctgccgtc gcgcaccgct gagcgatttc gccgttcggc ggccaagcgc gatccgatgc 136501
gagacgatct gcagacactg agcggccaag gcttcatgac ctatgaggcg gtggtgcgag 136561
gctgggggaa gcagcgtcag gcgctggccg gccggctgag cgagcttgtg cggcgcttgc 136621
agaacggacc gctgatatct gtagtcgtgc ccgtttataa tcccgatccg gccctgctgg

Figure 3 (Cont.)

136681
tcgaaatgat tgagtcggtt cgagcgcaaa gctatgccaa ttgggaattg tgtctggctg 136741
atgattgctc gaccgatccc gaagtgggcc gcgttctgcg caactacgcc gcacaagatc 136801
cgcgagtgcg cgtggtcttt cgtgaagcga atggtcatat gtcgcaggcg agcaatagcg 136861
ccatcgagat tgcgaggggc gcctacattg cgcttctcga tcatgatgat cttttggacc 136921
cggatgcgct ggtgctggtg gtgcaggtta tcgatgcgca tcctgatgcc aagatcatct 136981
acaccgacga ggataagatt gttgagggcg gtactcgttg cgatgcgcat ttcaagcctg 137041
attggaaccg cgatttgctt tacgggatca attacatctc gcatctgggg gtttttgatg 137101
cggcgcttgt gcgcgaggtg ggggcgttcc gcgagggctt tgagggcgcg caggattacg 137161
acatgcttct gcgctgcatc gagcgtgtcc aagatcgcca gatccatcac attgccaagg 137221
tgctatattc gtggcgtgca actcctggca gcgcggcggc ttcgaatagg gcgaaaccct 137281
acgccaacga agcgggacgc cgcgcgctgg aagagcatct ggcgcgtacc acgggcaaat 137341
cgattccagt tgtgctgggc ccgattccct tcagctatcg cgcgctttgg ccgatggagg 137401
ggacgccgct ggtctcgatt attattccga cccgcgacca cctaaacgtg ctgcgcgcga 137461
cggtggagag cattttgggt aggactatgt atggcaattt cgaactgatc gttgtcgaca

Figure 3 (Cont.)

137521
acggctcggt cgaagcggat accctggagt ggttcggtca aatcgagggc agcgatcggc 137581
gtgtgcgcgt gctgcgagac gcccgcccct tcaactattc cgcgctgaac aatgccgccg 137641
ttgcgcaaag tcgtggtgag atcgtggcgc ttgtgaatga cgatgtcgag gtgatcgcgc 137701
ccgactggct atccgagatg gtggcattgg cgcagcgtcc gggtgtgggt tgcgtgggtg 137761
cgaagctgta ctatccagat ggccgtattc agcacgctgg tgtggtgatt ggtctgggag 137821
gtgtggccgg gcatggacat ttgctctatc cgggtgagca cgccggttat ttctgtcgac 137881
ttaaattgcg gcagaactac agcgctgtca ccgcggcctg ccttgtgatc aagcgcgaga 137941
ttttcgacgc ggttgggggg ctgaacgagt ccgagctgac cgtggccttc agcgacattg 138001
atttgtgcct gaaggtgcgc gcggcaggtt acaacaatgt ctggacgcca tgggctgaac 138061
tctatcacca cgagtccgcc agcaggggcc acgaagacac cccggaaaaa cgggcgcgct 138121
tccggcgaga ggtcgactat atgaaaaggc gatggaaaac gcatgacttc gccgatccgg 138181
cttacaatcc aaacctagca cttgagagaa acgatttcgt attgtcttca cctcgttggt 138241
gtatcagcac gaaactgacg tgatggccga attggctggc cccttacagg cgtgtagcgc 138301
tgccgtggca actgttgggg catccaggca gctcgcgcat ctgaaccagc ttcgcttggg

gtcgcgttcg actatcacca cgccagagga gctcatcggg cacatgggca agagagtcat 138421
gcagtcgcaa agaatgatcc tgaactgcga atccgtgacc taactgagct gggtttgaac 138481
gaaagcgcag attccaccga ttccgcgttg cgtgcctgcg acgggattgt cgacgcaacc 138541
gccgacgcgc actgctttaa tttttgcgcc gcggtcgcag cctctcatat ggggagaagt 138601
gtttgtcggc agcttctgct ttccctctgc aaggaagcct gacagcaatc tctccattgc 138661
cgccgtcaag tcgtccggct tctcttcgcg gagcctttcc gcctatgcga cgaaagccga 138721
gagcaggctc ttcatttcat ccggcgcgtt tctcgaaccg cctgagcatc tccagcccgc 138781
tttgtgcatg gccgagaaaa tcggcgtttc gctccgtaat ctcggccagc atctcgtttg 138841
tgatgcgctc gcttggcgcg gcgaattcac cgtcgaccgc agtccacgta aaggacgcgt 138901
tcttggctcg gggcgacgtc tcgtgaaact cgtcctggct ctgcccgaac gcctccatgg 138961
cagcctccca gtcgccacgg gctttcgcat ctgtttcggc ctcggagccc ttcagcatat 139021
acgcattcga tttgttcttg gccgcgtgac ccccgaaggc tgccagcacc ttcttctgtt 139081
cgagctgatc agcacggccc agtccccttc cgggcgtacc ggggatcgct tgcattcgcc 139141
gcattagcgt ggcgatcgtt tgagcaatct gggttttgcg tcgcggtcga cagatacggc 139201
cacaggcgcg gaatatcggc cgccggaggg ccgggtggat ttgccaacgt tggcaggggg

Figure 3 (Cont.)

139261
cgatacgcaa cgcggcctgg gagcgagata atccagtact cgccgaagct cccactgatg 139321
agtctgctct ggatcgaacg ctacgcgctc ttggacgaaa gccgacggag cggattgatc 139381
ctcctgccct tcccgaagct cctgtaaccg actgctagct tcgcgcgacg gcctgggctg 139441
cgcagtggcg ccgccgataa gcctcggttc catcagtact gcgctttcag gattgatggg 139501
gaccacagtc tcgagctgag gactgagctt agctcgagga cctacgatgg gcgcgcccgc 139561
cgaccgaaag gtccggagat ggtctattgc cccaaggagt ttgccgggat taccctttcc 139621
gatgaacgcg gacacgtcac cgctcaatga cttactgtcg acctgagcaa caaggcttgg 139681
tttgtttttt gcgaagagcc aacggctaaa gctacgaaga ggactcgcat atgtgcaggc 139741
ggagtctctt gccatcccgg ccttgatgaa ggcctcctca agccccaaga gttcgtgagc 139801
atcctcggaa taacaggccg ctcccacgga tccccgcggg ccacaatccc agttggttga 139861
gccggttgca gcgccgaggc ggctggcatt gccccaccac cttcacctga attggcgacc 139921
tcgctcagct gctgctcaat ggcaagggct tgcggattgt ttagggtcct cggcctcttc 139981
gctgctctca actcagctgt gtcatgctca tcgttgatga ggatttcctc gcttggcaag 140041
aggctgctcg tggcaactgc acccatcggc tcgtccgggg actgctggct gtcaaacaca

Figure 3 (Cont.)

140101
ttcgttgagg gactacggtg tggcccctgt caggcatcgc gttatcggct tggcgcgcct 140161
cgtgtaattg ctgctcaaag tcctcttgcc cggatcggtc cggttgatgc tcttgcgaga 140221
cctctatctg cggcccggca gttacattga acgattcaac attgtgcggg tccacgctag 140281
cctcacgcca tgaaatcaat tgagctggtc ctattaggat aagctttcga gaagctgacg 140341
aggacgtcgc tcgtgaagca aacgcacccc gagaatgccc tgcggtcctc gatgggtcgc 140401
ggggcctttt tgcgtttaag gacacgtcgt cgcggctaat acagcctttt ggcagcgccg 140461
ggggcgagac gcgttagcgc tctgttgcga agggcacggc ataccggcgc cgccgatcgt 140521
gtcgagcgtg atacttgcac tacggacgtc gaggccgtgc cctgcaaagg gggcgcgcat 140581
ggcgccagca tatagcacga cacgcgtgac cgaaagatga ctgacggctg gagatgtggg 140641
gcaagcgcct gacgcactac tcgccatgtc ggccctgggt ttgcaacaaa ggcgtcgtca 140701
agtcggaccc cacacagcca agctcggagc cgatcgtcgg cgatcccgaa tttcggcaag 140761
attgataaac tcctcaaggg ctgggatcgt ctcatccatg cggccactgc ttcatcacgc 140821
caatattgcg cgagaacgga gagcacgtca ttgccatgtg cagctaactg gctttcgatc 140881
aagtaccttc gcttcacttc ccgataccgt ccgcatggca cttgaatccc ccgccatcac

gatatgatct gtttgcgggt aaatcgatca atcgtttgaa cgggtctcgg gatatttgcg 141001
cgcgccgcga actgcgggtg cgagcgcccc gcacggggag agaccgtaag ttcgcgccca 141061
ttcattctaa acccgagtgt tttggcgtat ccatagtgct gatgagtggc atgcaaacat 141121
tcaatttttc cagcgccacc gatgtctcgt aaaactagag atgtaaatgt gattcagggt 141181
gtcacagaag aaattcggac ttgaaaaggg gaggaaatgt tcgctctcag gataatccat 141241
atcgccctat cgtcgccaca aggagacttc caagcggagt cctttgcgcg cgcgctcagg 141301
tccggtggat actgtgcaga agaagcagtg gggcgccatg cgttgtgatg aaagatttgc 141361
cgcgactttt ttcgtctaca tatcatccgc gtcgactcta cagccggtac aaaaatcgcg 141421
ccacggcccc gttttgtttg agggaatgcc ggggccccct tgcagtgggc gcgcagcggt 141481
cggctgtcgc ggagaaatgc acagggcatg ctgcaactgg agtaaatgtg ttgcgcggcg 141541
ttgtgtaccg atcaggcgag cttaccagtc gtaatatcgc gccggatctg agtctccccc 141601
aagtggcggt ctgctgcatc cgattcggca accccttttct gcgcggcagg gttgggaaaa 141661
gaagacacgc gcccgctgat ttttcctgag cccctttttag cttgaagcta cttgaagcag 141721
ttaaccgcac gagagggcct gcacaatcaa gagtgaagta gtgacacctg gagataaaag 141781
atcacaagaa ctgctgatcg aggcagcatg gcatgcatat cttgcaaaga acttgccaaa

Figure 3 (Cont.)

141841
cacagggatg cgcgatgttt tcattgcggg gtacgtggct tgcaattcaa ttgcatctca 141901
cgaatgtgaa tgtaaacccg actatggttc atgttgggcc gtatctaagc tggttagcaa 141961
gttccgcatc tggcgacgca acgcaaagta aacatgcgcg ctacgcaata tcaatcgagt 142021
aattgatgga tacaatggcc aattcaatat taggacagga aatcactttc ctcaaacttg 142081
atacccgagt gatcaaaaat ttcgacaagg ttcttacgaa taatattgag gttgtggaaa 142141
cgtctctgtg gtctgtagta agaaagaacg ccttaaaaaa gggcgcagca aaggcactgc 142201
aagcctgcgc gtcgtcagtg ctgcacaaaa gatcggacta tgaattcttg accaccggca 142261
atgtgctgcg aaaaaaaatt cgcctcccgc gtttgttcgg caataaggta atttccgcgg 142321
cttactcgtg gataaaacgc gtgcaggcag cgcttttgct cgattatttg aaagaacatt 142381
tatcccagta tgactgggac cagctgatag ttgtcgtgtt taacgggtcg aattatccag 142441
aaagcgtgct cgccgaagca tcgaagggat ttaagcgcgt ttttgttgag gatgggtttt 142501
ttcctgggac gctccaaatc gacccagtag gaataaacgc tgcaaactcc gtgcctcgct 142561
gtagcgcttt ttataaaagc ggcagggatt tttcggaggg agggttacca acagctgtga 142621
ccaataggtc atcaaaaaga aaatttaccc ctgtcgatct ggccccgggc tttgtctttg

Figure 3 (Cont.)

142681
taccgtttca ggtcccttcc gatatgcagg taacgcttca ttcgccttgg gtgaaagaca 142741
tgtacaattt ttacgatatc gttgttaacg cagctgagca aaatcctgag gagatgtttg 142801
tcatcaagga gcatcctaga ttcaagagat cggtgatcgg cagtcgtccg ccacacccgc 142861
gcgtgaaatt tgcaaacgga aatatcacct ccgaacttat ctccaatgcg aggactgttg 142921
tcacgataaa ttcgacggta ggcattgagg ctctgctttt ggggaagcag gttattacgc 142981
ttggcgactc ctgctacaac attcaggatc ttgtgttgag aggaaatgat atgggccggc 143041
tcaacgccgc acttgcgctt cggggatggc ttcccgacga tgaattgcgg aggcagtttc 143101
tcggcttcct gtggaattac tacttagtta agggtagctt tacagaacca ccaaccgccc 143161
tggcctctcg gattctcgat tgtttcgaac tggactcaga agtgagaggt gccatcgcaa 143221
atttgaacaa ttgaatccat ctctgcagag ttctctgcgc ctcttcaggt tgtgagtgtt 143281
ttaccttatg gtggtgggcg gcctcggctc ccgaggcctc ctccaccatc agaccacgtc 143341
gtccattttt tattgcacgc atttcgggct tgcttgagga ttgaggcagt tccagcgttc 143401
tgttgatggg attgcaaacg ttgccgatgg tcttcgagag tgcgtcgaag gtcgttttga 143461
agttggcgag agctacacct tcacgtattg aaacgagacc ggaagttcgc agagtgatgg

ctgactggag tccttttccg acagaacgta cgtggtcatc tttggccaat tgattccgat 143581
ggcgggatcg tcccatttca gtccgcgatc atgttcagcg ctatagggcg ctgtcacctt 143641
gtagctgatt accgtgtccg ccttaagcgt catgaaacca tgcgcgaagc ccgcaggaac 143701
ccaaagctgc gcgccatttt cctgagatag ctcggcggaa acccatttcc cgtatgttgg 143761
tgacccgacc ctgacgtcca ccgcgacgtc gaacagcgcg ccgcgtgtac agcggacaag 143821
ctttccttgc gcgaaaggct cgagctgaaa gtgaaggccc cttaccgtcc cgatctgagc 143881
ggagagtgat tcattatcct gaacaagtcc gacatcggca acatttttgc ggaaccattt 143941
ttccctgaat acttcgctga aatagccgcg gcaatcgcca aacttcctag gcctaattaa 144001
cttgacttcg gctatcgaca ggctttgaaa atacatttcg tccaactcag ttccgcccac 144061
taattctcgt gctctggcaa ggagttgagg ataaaaaccg aacctcaact catagcgcga 144121
ttgtgggctc cgatccagag actcacttag gcgctcggca acagctgcaa ctcataaagg 144181
cggcggtata cgccatcttg tgaaagcaat cttccctgcg gtccttgttc ggcgacctga 144241
ccgccttcca tgaccacgat gttgtcagca gctgtgaccg tcgagaggcg atgggcgatc 144301
atgatagtgg tccgcttcct tgtcagccgg gccagagctt ggcgaatctg gatttcggat 144361
tccgaatcga gtgcgcttgt cgcttcatca aaaatcagga tttctgcgtt ccgcagcatc

Figure 3 (Cont.)

144421
gcgcgggcga tggtgatgcg ctgtttctgg ccacctgaaa gttttatgcc gttttcgccg 144481
acctcggtgt cgtagccatg aggcattttc ataatgaaat cgtgagcgtt ggccgtcttg 144541
gccgcctcaa tgatctcctc gtcggacgca ccctcgcggc ccaaagagat gttgtatttt 144601
atcgtgccac taaacagaaa tgtgtcctgg ccaacaaatc ctatccgatc gcgcaaggaa 144661
cggaacgtga catccttcag gtcgtgcccg tcaacagtta ccgagcctac gtcggggtca 144721
taaaggcgca taatcaagtt gataatcgac gactttcctg cgccggaagg ccccaccaag 144781
gctgttgtct ttccggctgg aaatgtgacg ttcaaattct ggaaaagtcg ttctccgttc 144841
ttgtaggaga agttgacatc cttgaagcgg atttcaccag ggccctcagg caatggtatt 144901
gcactattct tctcggtcag ttcaatggga tgatctgcca gttggtacat catgcgaacg 144961
cctacgagtg ccgattcaag actgatgcgc attcgcgcaa ggcgctttgc gggctcatag 145021
gccagtagca atgcagtgat gaaggacatc agttcgccgg gcgtgttgcc ctgctgcagc 145081
accaacactc cgcttagtgc gatcacaccg gcaatggcga aacctgagag ggtctccatg 145141
atggggctgg atgcagcttc cagccttgcg attgagttag cccgccgttc gacatctcca 145201
atgtacttgt ccatccgcct tctcatgaaa tcctcaagcg cgaaggcctt tacaatccga

Figure 3 (Cont.)

145261
attcccgtcg aggtctcctg cacgctctgg attatctgtc cgattgaagc aatctccaat 145321
tccatgatct tccgcacttt tctcgttagc acacgaaccc cgaggatagc accaggtcca 145381
acagcggcgg aaacaagtga aagtaacggt tgttggatca ccatgaccgc gagcagcccc 145441
attaacgaaa acagatcccg tatgaaggag gttacgacga gctcaatgac cgaacgtacc 145501
gcctgcgcat tgttggtgag gcgaaccaac agttctgaag atggataaat cgaatagaaa 145561
gacagaccct gcctaagtac gtgctcaaaa agcctgcgct gcgtatgtgc gattatattg 145621
ttgccagcct tgctgaggaa tattgactgc acgtatgtcg caagtccctt gactgcgaaa 145681
ataatcgcga ctgtcaccgc gacgccgaaa accttttcaa tgtcttttga gacgactgtg 145741
ctattgacaa catcacgcat tatccaggcg cttgcggagg tcatcaccgc tactacgacc 145801
atcgagccga ttgcaattcc gtaccaaggt gcctggtgtt tgaaattttc agctaaaagc 145861
cgcatgagaa ggctttggtt tgacttggaa atgaatttct ggagcattca attatcacct 145921
ttccagtccg gtcttggaga ggagcggaca gtcattttgt taagcagcat aggccttcgg 145981
tggcagccta aatgacccgt gtggcgttca aattgcaaga cacatgaacc tgcttgtgga 146041
cacaatcatt tactaaggac aattccacag tgctatggat caaaccctta gtcgccgctt

gtttctatgg cacaacccgc agactgataa ccagtgtaga aatgaaagac acatgattca 146161
tacgtcaaaa atttaccgtg aaatcaaccg tatcggcgtg caaatcaagg ggctccccga 146221
ctattggatg ggccaggcta gaaggatcag ttatgatcgg gttgggtcgg caggaaacac 146281
gataacggaa ggtagaaaac cagtctcggc ggacatggct attttgctca tttaccaacc 146341
acgtgggctt ctagagtcgc ttttttaca attagagcac ctgctctcga aaggactggg 146401
cgtcgttatc gtcagcaacc gcaaggtttt ggagcacgat cgcaatcggt tgagtgaata 146461
ttgccatctg atcattgaac gtaagaatat tggctatgat tttggcggct atcgagatgg 146521
aattctcgcg cttcataagc gttcaattca tcctaagagc ctctttgtga tgaatgatag 146581
tgtatggttt cccatacgga aagactgtga tcttattgat aggtgtcgcg aatctaggtc 146641
agatatagta ggcgtttttt ataacaataa aagcaagttc cccaagaacc atcatctaca 146701
atcatatttt tatcgtttcg gtgaaaaggt tgtctctgat agtcgctttc tagcgtattg 146761
gcgtaaaata ccaatgtaca atgacaaacg caatgtcatt aggaatcttg aaataaaatt 146821
aaccaaaaat tttcagttga tgggcttcgg catcagctct ctttacgcgc ctgaggatat 146881
attaaaggcg tttaaaaata tcgaagttcg aaatatccgt cccgtcctgg attactatat 146941
ctccgcgttg ggatatgacc agaatacgtt ctggagcgcg tataaaaatg agtcaccaaa

Figure 3 (Cont.)

147001
aggaggtgac acccatgcat taccgataga cgttcctaat agccgagttt tcttccattt 147061
tcttgacgct cacccagaga ttctcattcg caagttaaac tctccaatca ttaaaaagaa 147121
tcgcgataaa cgctttgtcg cacaacgaaa agcgataatt gagggagggt ttcttaaaga 147181
gattgacgcc gtcattcaaa aagaattgat caattgggat aggtagttga tattgtatcc 147241
aggtcgtcgg aagcgtgaat aatcacacta tcaaatcagc cacgtagatt aaggcgctgg 147301
ttatgcccct tagagcagct ggaacgggct cttgatgcct tacgtccgca ttaatgggag 147361
tcacgcagca gcgaagtgat gtgcacattc ctgaggtcga ccattttagg agacggcgcg 147421
tgctgaaatg cggcagacca ctgctattga attttcatgg aatggccgaa agcaagagaa 147481
ataccgtgaa tatcgccaga tgaacggcgc cctgtagtac ggtcgttctg cccgttccca 147541
gtgtgatcgt accgacgaac agcgtcagga tcagcataat gaggttctgt ggcgcgagac 147601
ccaaagcaag atctcgtcca agagcgaccg atatggcagc tactactgga attgtcaccc 147661
caatgctcgc aagcgcagat ccgagtacga ggtttatgct attttgaaga cgattcatta 147721
aagccgcttt gacagaggtt atcccttctg gcagcagaac gactcccgcg atagttacgc 147781
ccacgacggc ttgtggcagt cccagcgcct cgacggcgct gtcgagcgga taagaaagta

Figure 3 (Cont.)

147841
gcattgccaa taggatgact gcaatgaggg ccagcacaag caaggctccg gccgctagcg 147901
gattacgcgg ggtctcatgg gtagccggag gcgaagcggc gtcttcatca tcgatgaaat 147961
agtcgcgatg gcgaacagtc tgcacaaaca gaaacacacc atagaggacc acagacacaa 148021
gtcctatgac gacaagctgt attgcagcaa actgctgtgg ttttcccgcg gtgacgaaat 148081
tgggcagcac gagagacagt gtcgcgagtg tgcctagtac cgccagtgcc gccgacgcgg 148141
cattcaactg gaacgactgc tcgcgatggc gtcggccgcc aagcacgaga cagaggccga 148201
tgacgccatt gagcacgatc atcacggcgg caaagaccgt atctctcgcg acttcttcgt 148261
ttccctccgc gccggaaagc atcaaagaac ctatgatcgc cacttcgatg attgtcacgc 148321
agacggcgag gaggatcgct ccagaaggtt ggcccacccg agcggcaaga atttcggcgt 148381
gatgtacgga agcaaagacc gcacctgtta gcaagccggc cgacatcaac agaagtacga 148441
cggatcgttc cggcagcacg tgcgccaatg tcatagccgc gatcacacaa ccgaagagcg 148501
gaatgatcca agaccacagc gggacgtgtg cggacctgac ctgcaatctt gatttcattt 148561
tccatcccct ggtgatgagt atgcgtggtt ccttgcgcgg taatcggcgt aacaaaacta 148621
aggcttcgga aagtcgggcg agattcgcca agtctagtca gactctagac gagccgtcga

```
       gtttggcgtc aaccgcccct cattgcagat gcaagaagta tgctctgcct gccgtgcctt

148741
       tcatgtgatt aggtgcgtca aggctgtcat gtacttgaag gtgcacggag ctaggctcca

148801
       cagtccaatc caggtctcct attttgtgag gctctgctcg aggcgcacga cctcgcgtcg

148861
       caacgcttcg atcgctgcat cgcgattgcg aagcgcttct agctgtgtgg ctcggtcatc

148921
       ctcggaagcc atgagcgccc gtttcagctg agccaccatt gatgcgccca gctgcaggtt

148981
       ttcacctaat ttgaactcgg gcagccgttg cgcttctcca agtgtggagg agctggagct

149041
       aatggtgttg tcctcttcag cttgctgaaa gatgctgttg tactcacacg caccggcggg

149101
       aatgccttct ccctcgccac gacgtaagtc ccaccaggtt tgaaataccc gacggtatcg

149161
       ttccgttacc gctttgcccc tgtccacgat cccagcgtct cttgcgtgct gaagtgactg

149221
       ctcgtaaccg agttccacca ataggtcagc gccgactaga tcggttactg tttgcatctc

149281
       ttcgatggtc agttcggttc gccaagtttc gactgagcgg ttgtcgactg cctttttctt

149341
       caggagccgt cgatccccaa agctacttag ccggagatat tccgtttgct caactcctgc

149401
       aaatacaatg ccggctggat cgtagccgag cccagcgatc acgcgctgga tttcctcgtc

149461
       tgggcgctca accaagcgtt catagcgtac gacttgcgtg tgccggcgcc cgcgttgcat

149521
       cgcaagcgcg ggtaggccta gcacgagatc ggcgagagcc agtgcgacag cagcagtagg
```

Figure 3 (Cont.)

149581
cgtgccggtt acgagctcgg cgagacagga tacactggtc ggcgggcacc tttctgaaac 149641
gaacggaacg ccccacgtcg atttcagtga tgccgcaatc gcatatggat tacgcaacaa 149701
aaggatgtgt ggtgcttctg gatacaggga atgcaaatag tcgagcacca tccagtaccg 149761
cggagtcttg tcgatcaacg tgcgcttgcc cgctgctgct aagtattgag agtaagcggc 149821
atcggcaaaa actcggctga cgctaatgcg atctatccgc cccaagaatt cgcacgccgc 149881
aacctggatc agtgatgccc ctgctgggtg acggtggtcc actctaccaa atgcctcgag 149941
tgccaacatc agccagggct caggcggggc tgtgatgtcc gggtgctgct ggagcaaatg 150001
cgccaacagc gtggtccccg agcgggggat gccgaggaga aaacagatca gagggagagg 150061
gctgacatcg cggctcatga gttccgattc cttatgcatg cttgtgagaa cacatacccg 150121
ccgcgcgtga gtttctgatc gagccactgg gcgtgcgcca ccggttggtt acagtggtgt 150181
acaccggaga attcttcctc agaaccacgg cacagaccga tagccatcct gatgcgccgg 150241
acttcttcta accttcgtct gctatgcgcg gttctcgcaa gcccggtcaa atcgtttctg 150301
ccaatgcaac acatccatgc tttggatgat ggcgcgaagc acgaaaacgc gtgcgaagtt 150361
cgacatctgg gatggtgcag actgcattct gccccaacga ggaaaccaat gtgctgacat

Figure 3 (Cont.)

150421
cgggaacgca ttcgagcata ggttttttgg cccacagtgg aatgtttacg aaacgcactc 150481
gtcaacccca tcaaaatgat ggcctcagcc ctcatgtccg tcgcaaatct ccattccgcc 150541
gcgaacggcg catggcgcgc gagatgatgg acgaaggagg gttcatcgaa attcttgtcg 150601
ataagatttc gagatgacga tggggcacgc cgtctttaag gcccctttt gcaccgcgct 150661
tcatacccgt cgagcggcga gacgaggtca atctcactgc cagtagtgcc gctggccttt 150721
cccttggggc cgatgccagg cagtgatcat taacgaccgg tttttgggtg gagcggctga 150781
caaagcagca tggattttcc gtcacccgca gaaccacacg tgatgaatat taagggcgag 150841
ttgggtcgcg cttctagctc gcccagcggt gaggacggat gtggcatcat gaatatctcc 150901
cgcttcttct tccccatccc gcttccacga cacccccaag caactgaagt agcatttctc 150961
cgggcagtcg ttcccaagca gcaagggcgg caaatgtgat gcgcaccagt gggacagccc 151021
gcaacatgga agagaacaag ccgactggtg ctaaagcttc gtgtttctga gcaaaacgtc 151081
accctccact ccgcgtggaa actgagccac caattcgaac gaaggcagta ggtcaagaat 151141
tgcgcgcagg ggcagttgac cttcatacag ctcctggtca ctatattcag tgtagatgaa 151201
gcgcgtcttg gttagagtct ctttgccgcc agcgatgacg tcggactcgg ccccctgcac

atccatccag atcaggtcga tactctccaa gccagcctca ctgcaccaat cgtccagtct 151321
ccgagtctca actgagatgg gtccgtcaaa ccggacccac tgatattcgg aaaggtgatt 151381
cttgggctgg cgtattgagc ctgacagatc ccattccttt gcgtctccat ctccattact 151441
ggggtggaaa tcgattctgc cgtttcgatc actgatcgcg acttcaaata gcctcatcct 151501
gtccaaaggc cccatgtttt ccctacagcg agcagcggct cgggggtctg gctcaaagca 151561
gaaaagctgg gccttcggac gaagctggag aaagcgtcgc gcatcgcttc catcattgca 151621
accgatgtcc agaatcacgg ggtcaggctt ttcaaggagc gaaacgatct gtcgatggac 151681
cttcaaggaa gacgttggct ttcttatgcc ctccgcaaat tcgcgaaggc gttgctgaag 151741
agagattagc aggccttctt taagataccg tcctacttcc atgaaattac acctcaatat 151801
tgattgcagt tgcgggtgct gaccgctggt gaggcattga gtgctcgtgc cgcgcttcgg 151861
tgaatcctca agggtatgct gtcaaatgcc gcgccatcac tcatgagcgt ctcggcccca 151921
ccagcatggg tgaaggagag ggacggaact accgcgattg tcataggcgg gcaccgcttt 151981
acagattgat tggacttgat agtggttccg ctgcagagtc ggcgcgcatt ggatgcagtc 152041
gcacgctacg ctgctcccaa agcccacgca gttcatttag gagcgcttca cgctggttct 152101
gattgggcgc gatgaggtcc aagatatcgc cgagcggagc ttctccatca atccgcatta

Figure 3 (Cont.)

152161
gcagttcgaa caactcggat gaaatccgca cggcttctcg gctggaggga cccgtgcgga 152221
tctcgcatac cgtctcttgg cgatctaacg ccgtaaatgc acgcacttga tggaggcttg 152281
aataaggcgg caacgaaagc gcaagtctac tccaatcctc cggtgacgca gtccgcttct 152341
tgatgagata tgacccaacc acgagtccat ccaagtcggt ggtcaaaaat gtggtcaccg 152401
catccgcaac cgaatccact atcggctcaa cattattgtt gaaggacgtg ttgagcagaa 152461
tcgggacacc tgttcgtttc ctgaaggcgt tgatgacctc ccaatacgct tgattgatgt 152521
tgcgcgatac tgtttgcaag cgcgccgtac catcgacatg cgtgacggca ccgagcagat 152581
tgcgcttcga ttcgcgcaca ggcactacga aattcataaa gggaaattcc tgcctgctat 152641
ctggcaattc aaagaactcg ttggcgtcct cctccaacac ggatggcgca aaggggcgat 152701
agccttcgcg cttcttgaca atcgcgttga tccgatcctt gtttgtggct ggcctagggt 152761
cggcaagaat gctacggttg ccaagcgcac gcggtccgaa ttccgatcgt ccctgcaccc 152821
agccgatcac ggcgccatcg gcgatccact cggctgctct gctggccaca tcatcgcagc 152881
gttcgatttc aatgtggccg ccccatgcta ttaattcctg ctccacggcg cggtcgctcc 152941
cgagatcagg accccaatag acctcctgca aacgctcccg aggtgcggac tgccctagtt

Figure 3 (Cont.)

153001
cattagacat catcaatgca gcgcctaatg cgcagccagc gtcgtgtgcc gcgggttgca 153061
cgaagatgtc ttggaagatt cccgagcgca acagcttgcc gttcaatgtg cagttgtgag 153121
ctactcctcc ggccaagctc aagcgcttta tgccggtgat ctcgctgtga tgccgtagaa 153181
cgtgaaacac aatccgttcg agtgcttctt gcaacgaagc acttaaatct ttatgctgct 153241
gagtgaacgg cattcctttt cggcgtacct caatgctgcg aagcagcgtg ggaccaatcc 153301
ggtccagata gatccggtag ccaccgttgt ctaatagctc gtagaactgt tcgaagaggt 153361
cgcgatgggg agcggggtcg ccgtacggtg caagccccat gaccttgtat tcatcaaaca 153421
tgccgtaacc gagatatttt atggtctcaa ggtacaaaag ccctaaagaa tcgctctccg 153481
gaaatgtcgc aagcggtttg acttccgtgc cggatcctac cgccaaaaga cccgaggcga 153541
agtctccacc gccatcaatt gtcaagatga gactttgttc gaaaccagac atagaaaacg 153601
cgctccaggc gtgcgacagg tgatggctta cgaatgagat tcgcgacgga tcgacctcag 153661
taccaaattc ctgcgcgagc aacccacgca acaacagctt ggcatccaac ggtattgaca 153721
tgtgcgactg agaaacgagc aggcgctcga gcatagcatt gcaaaacgcc tcggttgcat 153781
aatacgcgat gcagtcgatg tcgctgagtt gaaccccggc gtattcaagg cagtattgaa

tcgaccggcg cggcagcttg ttggaatgtt tgattctgtt aagtcgctcc tcttcgacag 153901
cagctatcac ttggccgtct cggacgagaa ccgctgcacc gtcgtgcata aatgtattcg 153961
gcagatcgag cgagttttcg tgaatcttgc ttagaccgcc actaagtcct agacacagca 154021
tgttgtctcc aatctctcgt cacttgtaac aggtaggcca tgtgctccga ctgaatttag 154081
tcgtttgcta agctcaagca gtgctctttc tgccgtaggt caggacagca aacgccgctg 154141
aagcagtccc acagataaga agaatggcat cactgcaaat atgcaaagcg cgctgatatg 154201
cagagcgacg cctccgcctg ggcgatctag catcgctgga cgaatgagct cgattgaatg 154261
tgccagcggc agcagatgcg atagcttctg aaaaatgtcg ggcagttggc tgactgggaa 154321
gaccgctcct gacaaaaaca gcatgggtgt gaggaagagc gtctggtaaa atatgaaata 154381
atcgtaaccg ggcgcaagcg ctgtgacgat catcgccagg cttgcaaagg cgaaccccgt 154441
gagtgcgatc actggcaagg caaagagaac ggatggccac gatgcaaagc ccattgtggc 154501
tgcaacgagc atcattgctg tcccggccaa taacgccttg ctggctgccc acgccagttc 154561
accgaggacg atgtccccga gcgtgagttg ggtgcacagg gctgattccc aagttcgttt 154621
tgcctgcatg cgagcgaagg tcgcgtgaat agtctcgaac gtcgcggaga tcattgcgct 154681
tgttgcaacc atgccagccg ccaagaacgc gacatatgga atgccgtcga cgcgacccac

Figure 3 (Cont.)

154741
cattgcaccc aggccgaagc cgagaccgaa cagcgaagtc acgggctcgg cgaggttacc 154801
aagaattgaa gcgatcgcgg ctttcttcca tgccatgtaa ttacggcgcc acaccgcaat 154861
ccaattccaa ggattggcgg gtaggaccgc cgcgtaacgt ttccacatcg ctcagtcctt 154921
catttcgcgc ccggtcaacc gcaagaacac atcttcgaga ttcggtggac gctgcaatag 154981
gcgtagaccg gttcgcccgc gcaattgcaa gcgcacctgt tctggatcgg aagaatagca 155041
aaacagcgtc tcaccgctca cttcgacacg ctgagcatat ggtccgacaa ctgaagtcag 155101
ctcccgcgga ttgccgccgt agatctcaat cacgtcgcac ccgatctgct cgtcgattag 155161
cgcgtgaggg cggccttcca cgatcttccg tccgtgctcg ataacacaca agcggtcaca 155221
taatcggtcc gcctcttcca tgaagtgggt agtcagtaga atcgtcttgc caagcgccaa 155281
caaggaccgc agccgttccc atattaggtg gcgagcatgc ggatcgaggc cggtagtcgg 155341
ctcatccagt atcaggagct gcgggtcgtt gatcagcgca caagccagcg tcagccgcct 155401
ctgcataccg ccggataatt gcgccacggg tacatccgcc ttgctctcga gccgagcgaa 155461
atcgagcagt ggtggaatgg cttcctcgag ctcgcgagta tgcaagccga agtaacgtcc 155521
gaacaccagt aggttctcgc gcgccgtgaa ctcgcgatca agtgtgtcga attgcggaac

Figure 3 (Cont.)

155581
caccccctatg cggctgcgcg ccaaacgcgc gcgggctggc accggctctc cgagcactgt 155641
gatcgtgcct tcatcaggcg gtgccaggcc gagaaccaga cgcgataccg tgcttttgcc 155701
cgcaccgttc ggtcccagca agccgaaaca ttctcctgag gtgatggtga atgacagttg 155761
gtcgacaacg actttgtcgc cataagactt actgacgttg gtaagctcga ttgccacatc 155821
tgatttggag cgagatagcg aattatccgc attgctatgc ccgtggcact tctgcttgag 155881
tgcattgctc tcaggccgcc gcgacggtga gcttgagaca tttgctcgag tcaatagctg 155941
caatttctcg tcctatctta aattcgcttg cctgtttggc atagccggct accgtcaccg 156001
cagtgactga ctgatgtcag cagcctcgca agctgcgcaa gactgagcca gcgacgcggg 156061
tgccgcagtt tcagacggct ccgcagcgct tgttttagca atggggttca ggagaatcct 156121
ttacgccgtt gggtgcggca gccggggaac cacgcgacag ccagtcgctg ttgctcaacg 156181
tgcacaacgc atatgctttg agggggagca ggagagcgac gttgaggagg gtgtgcagcg 156241
aaaacccaag gaatcgcagc tctcgcgctc gaaacgccgc cacgccgcag cggaccattg 156301
tcatagatgc aatcatcagg atcgtcgacc aaggcactgt ggccgtcaga gcgagctgtg 156361
ctagccccgt caggaccgag agggctagga gcagcggacc aagattctgt ccgatcacgt

ccagcgtaag atagcgatca aggcccggca gtaggcggag cgcgagcaat gtgtcgcgaa 156481
acgtgctgcg tgcccagcgc agttgttggc gcagataggc gcccatcgag tttggaacga 156541
ccgtcgccgc gatggcttcc ggaacgtact cggttcgaaa gcctgcattc agcatgagga 156601
ttgtgaggtg gcggtcttcc ccgaagtcgc ttggcctgcc tcgaaacagt tgcgtctcgt 156661
atttatcgag cagcaatagg agtgcggacc gccggtacat ggcacacggg ccgcagcaac 156721
acataacggc tccaaagcga gcctgtgctg cgcgttcctc gttgcaggcg agccagtact 156781
ccatgtcgat caaccgcgtc agccatgtgt cgctgcggtt gctggccgtc aactgaccca 156841
tcgccgcgcc gaccgcggga ctgtacatct tcagggcaag tttcgtgact acgtccggcg 156901
caatggtcgt gtccgagtca acgttgagca ccaaatctcc cgatgattcc cgtatcgcga 156961
caatctgcgc cttgcgcttt ccgacgttct ttggcatcag gataaagcgg aacctcgggt 157021
cgcacgcata atgatcgtgt acaggtatga tggcgttgcg attgccagaa ccgtcgtcaa 157081
ccacgtagac ccgcaactct ccagcgtagt cctgctttgc aatggaagct aggcacgccg 157141
agagcgcgcg cggatcctca ttgtagcagg gtacgataac atccacgctc ggcggtgcac 157201
cggagccggt cacgggcgtt gacgcagctg tggtgtttgt tggcaaagcg tatatagctt 157261
gcatgccttt gtaagccgtc gagagtgctg catacaagga gatggctacg gcgccggtcg

Figure 3 (Cont.)

157321
tgccaagcag atccatgaaa aaccgtccgt ttaatgattc tgaggaagcg agcggattat 157381
aaatccgcgg tcgtgcaagg cagggatgag acgagacaac gccgccaccg tctggtcgcg 157441
aaaactggcg tcagtgttcg ccaactcgtc gggagggcac ccatcgtgca ggagaatgat 157501
tgaaccgggc cggaccgagg cgagtaccgc atcgacgatt gcgtcgatac cggggcggga 157561
ccagtcccgc gggtccacag accagtgcac agccgccagt ccagcgtttg ccgatgttgt 157621
cagcacgtca tcgctccaaa ttccgtaagg cgcacgtatg tgccgcaccg aagcctcggg 157681
gcaggccatc ctgatggccc tgttcgcctc gagtacttgg cgttccacgt cccgacgtcc 157741
gcaggcagac aggtccggat gggtcattgt atggttggcg acctcgtgcc cttgcgcaac 157801
catgcgtcgg atgagttgcg gccggtcctt agcataagcc ccgatgacga agaaagtcgc 157861
cgggacacgg tgttcggcca gcacatcgag gacctcaggg gtaaaaaccg ggttaggacc 157921
gtcgtcaaag gtcaggtaga cgctcggggc cccagtgccg cttctgggca ctgtccggag 157981
atagtcaagc tgtttcatag ttccggaccg tttcgttcga tcagtgtgcc ggatggccat 158041
tcgctcattg gacgtccaat cggaaagacc acaacgagta cgtcttcagt gcgcgttggc 158101
ggcaggttga gatagacatc tgaaagggtg gaccgcacgc gaacgccagc cacaattgtc

Figure 3 (Cont.)

158161
ccgagaccgt ttcggcagag tctgcccaca agcttgtaca gcgcgtggcg aacggcgcca 158221
aatgcgaacg gaacgccaag ctgctgcagc accggataca tgacgcggat ggagtggttg 158281
agcccgagtc cttcgaggtc cgggcgaacc ccccacaaac ccagttccgc caccaacaga 158341
tcggcatcgc ccaccctgat aaagcggcgc aacagcccca tgtgagcagc cactccgtga 158401
gcgtcgtagc cgattacacg gagctccggc cttgctccgg cccaactgtg cccaccttca 158461
aatggtcttg cgttgaacgt cccggtcggt ccataggtct tccggaagaa ctcagcgagt 158521
tcagtgtggt cggagagctc cagctcattt tcccagcaca gtttccaccg catctgagga 158581
cgcatatcca aagaactcca catcttgctg cttcttgaaa cgtacatcaa acgtccgaaa 158641
tggccggggt cgatggacgc ccgacactgt cgtcgaaccc gcattgcgga ccaagttggt 158701
tgttattacc tgcacagtga gtgggggaca tttcccgacc ttcccgtatc actcgcaaat 158761
ctctaccagc gacacacttg atttcttcaa acgtgagcat cttctaatag tgattggatg 158821
gatccgtaaa attgattgtt tggattatag ccattcatcc tgtggataca cccggcccaa 158881
gtctccctgc tagcaacggt tgatgaacga acccgacacc gcggcgggag catcagcttc 158941
ggcccgccaa tcatgggcgt gcggccacgc tctcgaaaac aaggaagttg gatcaaagaa

caggctgaga cttggccgcc aacggcaatg aagctaatac cgctactgct cccgcgccgt 159061
tcggcagata cgtttcggcc acagccacgg cttgttcggc tcgggcagct atatcaggca 159121
gtgccgtctc gtcgatcagg cgctgatttt tcctgtagga tggaacgtgg gcgtaaccaa 159181
ataccgcaag ccggtcgggg cgcattgcga ccgctgccgt cgcgctctga acgcaggact 159241
gcacggtctg gtgcgggagg ccgtacatga ggtcgaagtt gatgcgactt atcccaatcc 159301
ggcgcaggtt ttcaatagcc gcggtcgtct gcgcctttct ctggacccgg ttggttgctt 159361
tttgaacaat gggatcaaag ctttgcacgc cgaggctcac gtggcttacc tcggccgctc 159421
ctaaggcttc ggccatctcg gccgtgaagg tgcgcggctc gatctcgaca gcgatggtag 159481
ccgttttcct gaaggcgaaa ctgcgacgca gaagatccat cagagccaga aaatcttctg 159541
gcttgatgat ggttggtgtt ccaccgccga agtgcacgtc gctcacgggc agcgcctgcg 159601
gcgcttgggc tgctaccaaa cttatctcct cactagcgcc gtcagatagt cgaggatcga 159661
tgcgtctcga cgagttatgc tgttgggaaa tccgcaatac cagcacatcg accgacagat 159721
cggaatgtgg agatacaacg acaccggatc tgacgccggc aagttcctca gccacccctt 159781
actagcttca gcgccgacgg ctgcggagaa atccggtata gtcgatcgtg taccatggta 159841
ggtgcgcctc gcagtacttt tgcaagagtg gaggtcagcg gcgcgacact tttgatcaaa

Figure 3 (Cont.)

159901
cgcgttgccg cgcctgtctt ttcgccgtca gccattatgg cctcccgctc aagccactca 159961
gcaggccccg ctgccgttcg acgaggatct caaaatccaa ccagttgcgt cgagaacatt 160021
gccggtcaga ttagccggta cttttcaatt ccttagtcga gaccgaaaca acaagggaca 160081
taaaaaatga tctctgtcgc ggattcgaca aacgggacag agttgtacgc aatcgattta 160141
cattttgctt gccaaaggcc gacggcaaat tcctgcagag gttgagctac ctgcgtgagc 160201
ttgctgccgg ggacacgcct tggcgaaggt ggagaatggt gctgttcaga agtagctcag 160261
ttgaatatcc aacaaacgcc agtagccttg ctgtttcgcg gaggaggagg ctaggcggag 160321
ccgttatccc ggcgcccgcc gggttgcacc ccgccgttgc atttctgcca ctgaggagca 160381
gacagtcggg ttgaggtcct tccgtggtca agttgtggac cagacagcag aacgctgaga 160441
cggtgagcag atgaatgcgg cgtcggcagc ccacaagagg agacgcatcc gagcgttgag 160501
aggggatgga tggttgccgg ccaagcggta acacgaaata gcaagcgacg gtggggaaga 160561
attccgacat ggtccattta ttgcaattga tagcattgtg aaagcagcct tggccattct 160621
gcaacttgaa ctaatcgtcg gatccccgct ttccgcgact acaaaattgc cgcaccttca 160681
cgcgctggca tgctcggatt ctcatagagg ctaaaacagc aatggacacg gaagcaatcg

Figure 3 (Cont.)

```
160741
ggctcgcaat agcttttttc gtcattgcac tggcgtatgc agcagtcgga caagctggcg

160801
catcaggcta cattgccgcc atggcgcttt ctggcttttc gccgttggcc attaagccga

160861
cagctcttgc tttgaacctg atggtctcag cgatcggcac ggcccaattc ctgaaggtgg

160921
ggcaggtgtc ctggcgtaac gtgtatcctt tcgcaattct gggctttccg gcttcggctc

160981
tcggtggctc agtgcacctt cccgagagag tctatcaccc ggttctcggg ctgatcctgg

161041
tagtttccgc cattcaaatg gcgcgatccg cgcttcgcaa gagcgccttg gtcataacca

161101
ttccgaaaac gccgccacta cacgctgcat tgatcacggg agctgttatc ggtttcgtct

161161
cgggcacgac cgggagcgga ggcggcgtat tcctcgcacc agtgatcctt ttcaagaatt

161221
ggggaacagc acatcagact gctgcaacca cggccgttta taatttaatg aactcaaccg

161281
ctgccttgat tggagcgtgc gcttcctgga atgcacttcc aaactttctc ccgtggtggt

161341
tgattgcggt agcggcaggt ggatcgatag gcgctttaat cggaagccga tatctttccg

161401
cttcctggct tcgcgtcatt ctttccgtgc ttctgatggt atcaggcctc aagctgcttt

161461
ggtgatggag tgcccatttg cttgcacgga aaacctttgc ccagcatcac gcaggagcac

161521
gcgcgaaggc gcaccattct catccgcggc taagaccgag agggccaatt gtcgctgaat

```

gtaatctccg atgaccgaac tcctcaccag cacggtacct ggaacgtggc tggcgcgctt 161641
gcgccgaagg tcgagacgtc caattcagca catcatgacg ccgacagcca ctctgtcgtg 161701
tacgatgccc gatatgccaa gcgtcccgaa aaccaccttg ccgccatcgt caacctcgtc 161761
gccacgaatc tgaatggcgc gatctctaaa gaacatcgca aattcgagag cggtcgccgc 161821
tcataagata aggctcggcg tcacgggtca tcggacagct ctctgccaat acggcaggct 161881
gtcggcgcca tatccaaagt gcggataatc gtgatgcaaa atatttattt tactggcctt 161941
agcaatgctg caaaaacgac cacgcttgat ttgcatcgat attagaacag ttccagagtg 162001
ctggcgttga aaccgttttg cggctcaaag aaaggattac ccgtggaaag catcatcggt 162061
tcggcatgta caagaatccg gttgtccata agggtggaca ggtttgggca gatgtagccg 162121
tcctgtacgt tacacttgac ctaatcattg cgtgaatgag ttttgccggc agttggggca 162181
accatggccc cgtttacgcg gcgcccatct agaaggctgc ggggagcagt cgctctttct 162241
gcccggcagg gctcggcatg tgactatttc ggagtttcta cattgccttc aaatatgagc 162301
ttaacggcgg atctcattgc agatttgctc agcgcggcaa acgaggtcga caaactcaac 162361
ccctatgaaa taagcggcct cctagaccgc tcgattgaca ccatccgcga tgtgcgcgaa 162421
cagactggtg tcgcaagttc atatatgcag ggcgttgtgg tttgtcttcg aatatcgtca

Figure 3 (Cont.)

162481
gagcgcgttg gccacctctc tgaggaggat gtcaggcggt ccctcgtcac tgccgcggaa 162541
gtcctgagtg cattggtgtc aaaccgtgtc gattgagctg ttcgcgccgc cggagtccgg 162601
accactccag ctatcttcga tcccgcaaac cgatgcggcg aattcggctg caatctcgac 162661
aggtattgcc gaagattgct tcagtcgacg ctgcttattg gaaccggcgt atccgattcg 162721
cgacgatgtc gaatacacga cataggcgtg tcgagaggca gcttcttgtt tggaaacgat 162781
ttctcgttgg catgatacat gcaggctaac ccgcaaatgc ccgagttgag gacttgtgag 162841
gaggatgcag gactaacccg caagagtgca gttcggggtg cgtcagcctt ccccgggcaa 162901
cgaggatccg aacagcaagg gggcggcaaa taggaaagca acggccgcga gggcgtttaa 162961
cagtgggtgc tgtgcgagga tcagtccctt gcaatggctt gccgccgata acgttgtaga 163021
aaaatagaca aggagtgctc aatggtcttc actggaaaat gtgatctgcg gagtccgctg 163081
ctcggacgac gcctgcgctt aggattcatc ggcggcggaa aggggggct tgttggacga 163141
tggcatttcg ctggggcccg gctgtcgaac cactgggaaa ttgttgcggg agctctttct 163201
tcggacccgg aaaacgcgca cgcttcggct gcagagtgga tgatagcgcc ggaccggtcg 163261
tacagcgact ggaacgctat ggcaacagca gaagccgcaa gggacgatgg tatagaggca

Figure 3 (Cont.)

```
163321
gtctcgatcg tgacgccaaa ctggacacac catcggatcg cgacggcatt tctgaaggcc

163381
ggcattgatg taatactaga caagcctatg accacaacag tttccgacgc ccgagaactc

163441
gtggagttac aaagagcgac ggatcgcctg gtcatcatga cttacccgta tgcacatcac

163501
gcgatggttc gccaagctaa gcacatgatc cgaaatgggg ccgtcggcac ggtccggcag

163561
gcccatgtgg agtatgttca ggagtgggcg acagcgccct tctcgtccga cgcgaagggg

163621
gcaatgtggc ggcaagatcc cgagaaggtg ggccgcgcgt cggccaccgg agatatcggc

163681
acgcacgctt atcatctcct tcacacactg accggacagg acattgccag gctcagggct

163741
gagtttcaca cctgtggcgc tgtgaaggcg atggaagaca ccgcctacgt cactttccgt

163801
ctcgagaatg gtgcacctgg gatcctttgg gtaacgcaag ctgctcctgg ccaatattgc

163861
ggtcttcgaa ttcgcgtgtg gggcgacaga ggcgggcttg agtgggatca ggaaaaacct

163921
gaagcgctgc gctatgttcc tttaggggag caggagcaga tttttgtgcg aggccacggt

163981
agtggaatag tacccgaagc agaacgcctg atacatctac cgcggggaca tggcgaagct

164041
ttagtggatg catgggcaaa tctctatgcc gaggctggcg tggcggtagc cgcacgccgc

164101
gcagggtatg ctctcccgaa agatagcgtc gagctttccg gggttgagga cgggctcaaa

```

ggtatgttgt tcatcgatgc ttgtgccgac agccacgaat ctggcggatc ttgggtttcg 164221
ataaacggtg aatccattcc caacttttgc tgagctgtgg agtgcggccc ttggggtgga 164281
cagaccggat gacgaattga ccggcctacc gggttttcgg aaagaaggcc catggcaaaa 164341
caccgaagtc acagcgtcga gttcaaacgt caggtcgcgc aggaattcct ggctgagcgg 164401
ccaaagttcg ggcgcccgat gtttggctga agcgtctttg agcactgcta gtctttcgcc 164461
cgatcacgat gctttcggct ccgattgtcc ggaaggcgcg ccagataagg ggtatccgtc 164521
cgagcgcgac cgcctttgca tattgagtaa aactgttcag accctgtcct tattcccatg 164581
cataaggaca gttgccaaca tggagatttt tgaaggagac agcgggtctc gggtgagccg 164641
tcttgaggtg atcaacaccg gacggcggcg tcgatttacg gaagatgaga agctgcggat 164701
tgtcgcagaa agctttgccg ggagaggccg tgcgtcggcc acggcccgtc agtacggcat 164761
cagtcgctcc ctgttgaacc gttggcgcaa atcggttcgc cagggtttgc acggccagaa 164821
acaaaccgat ggttttgtgc cggcgttcgt catgccggaa acttttgtgc cggtgaagca 164881
ggtcactcca cctgctgcga tggagcagcc ggtggcgtct ccttccggcc gcatggagat 164941
tgttgcggcg aacggccgtc gtgtggtcgt ggacggcagc gtcgacgttg aggcgctgct 165001
gcggatcatg cgggggctgg agacgttgcg gtgatcatgc ttccttccgg tcaaaatgtg

Figure 3 (Cont.)

165061
cgggtgtgga ttgcaacggg ccatacggac atgcggtgtg ggtttccatc gcttgcgttg 165121
cgggtgcagg aggtgctgaa actgaaccct ttggacggca atctttttgt gtttcgcggt 165181
cgcagcggat cgctgctaaa agtgatctgg agtgacggcc aggggagctg ccttttttaca 165241
aaaagattgg accgtggccg gttcgtctgg ccttctgccg aaggcggagc gatagcgata 165301
tcacccgcgc agctcagtta tcttctgtcc ggaatcgact ggaggcatcc tcaggaaacc 165361
tggcggccga cgaaggtcgg ctagcattat tctattgaaa atacagggga aatctgatcg 165421
aatggcttca tgatctcaaa gcctgtcgat cttcctgtgg atgttgttgg cgcttacctg 165481
gcgctgcgtg gcgagcatga agccttgcag gctaaacacg ctatcgcagt agcggaagcc 165541
gccaatgcgc aggcgatgct ctctgacaac gaggcgctga tcgttgctct ggaattgaag 165601
atcgagaagc tcaggcgcga gttgcggggc cagcgctctg agcgcacggc gcgcctgctc 165661
gaccagttgg aactgcagct cgaggaactc gtggcggcgg cgacggagga tgaggtcgcg 165721
gcacaagcag caagcgccag aacctcgagc gtacgttcgt tcacgcgcaa acggccggtg 165781
cgcaaaccat ggccggacga tatcgagcgc gaacgtgttg tcatcgagcc gccgacgact 165841
tgcacctgct gtggtggttc gcgcctgtcg aagctgggcg aggacgtcac cgagacgctg

Figure 3 (Cont.)

165901
gaagagatcc cacgccggtt caaagtgatc gagacggtgc gggaaaagtt cacctgccgc 165961
gactgtgagg cgatcagtca gacgcccgca cccttccatg ccacgccgcg cggctttatc 166021
gggccgaacc tgctggcgac gatcctgttc gacaagttcg gcatgcacag cccgctcaac 166081
cggcagagtg cccggttcaa atgcgagggg atcgatcttt cgacctcgac gctggccgac 166141
caggtcgggt acgcaacagc cgctctcatg cctgtcttcg atctgatcga ggcgcatgtc 166201
ttcgcggccg agcgtcttca cggtgatgac accaccattc ccattcaggc cagggacaaa 166261
tgcacgaccg gacgcatatg gacttacgta tgcgatgacc ggccattcgg gggaacggcg 166321
ccgccagccg caatctatta tgcgtcgagt gaccggcgcg gcgaacatcc gcagaaacac 166381
ctggccggat acggcggcat tctgcagagc gattgctaca atggcttcga gccgatcgct 166441
gttgccgcaa cgaaagcggt cccgatcaca ttcgcctttt gtcacgcgca tgcgcggcgg 166501
aaattctttg agctggccga tatccagaag aatgcgcggg atcgcaaacg gaggggcaag 166561
ccgatctcgc cgatcgcatt ggaagccgtc aagcgctacg acgaattgtt cgagatcgag 166621
cgccagatca acggattgag cgccgaagaa cgactggctg tgcggcagga gaagagcaag 166681
ccactgttcg atgacatgca cgagtggttg acgaaggaac gcgccatgct cagcagatcg

tccgaggtca tcgagccgat cgattacatg ctcaagcgct gggagggctt tgctctcttc 166801
ctcaaagacg ggagagtttg tttaacgaac aacgcagccg agcgggcgct gagaagtgtc 166861
gcattgggaa gacggaactg gaccttcgcc ggttctcagc gcggggccga tcgtgccgct 166921
gtcatgctga ccgtcatcac cacctgccgc ctcaacgata tcgacccgaa ggcatggctt 166981
gcagacgtgc tggctcgcat cgccgaccat cctgtcacgc gcctgtacga actgctgccc 167041
tgggagtgga aacgtgcatc ggcggcaacc gtcatgctgg cggcctgacg atggtggctt 167101
ccgtcgtccg cctgaaggtc accctcgatc atgtcgagcc gatagtgatg cggcgcgttg 167161
tcgtgccgtt caccatcagg ctcagtcggc tgcacgaggt gttgcaggcg gcgatgggct 167221
ggaccaacag ccacctttac gaattccgca tgcgtgacgt cggctttggt ttgcctgacg 167281
aggaatgggg ggatggtccg atcgatgccc gcagggtctc gctgctgtcg gcagtccagg 167341
acaccggtgc gaaatcgttc aaataccttt acgactttgg cgacggctgg gaacacagca 167401
tcaagatcga gcgcaccttt cctgcggtcg gcacggaagg accgatgctt ctcgaagcaa 167461
cggggcactg cccgcccgaa gacgttggtg gtccatgggg ttatcaggag ttctgcgagg 167521
cgcttgcaga cccggcgcac gagcgacatg ccgaaaccct cgaatggtgc ggcagcagcg 167581
attatgattc cgccgccgcc aacttctcgc agctcaacaa agccgtcgat gacctcgctg

Figure 3 (Cont.)

167641
caaaatgggc ccgaaaagcg cgccgcaaaa cctgaacgcc gggctgtggc cgaaggccga 167701
aagttgattt taccgtgtaa acaaccggcg gaacagttct tccgagcgcc gtagaccttc 167761
gtccgtcagc accagcgact tcgacttgtt caccggatca cagatcagtc ccctctcatg 167821
caaccggtcc gtcgtcgccc agtcaaatcc cttccaggcg caacgctcgt tgtggagcgt 167881
cagccataac agtgccagca ccgcgtcatc gattttgtcc tcgtcgatct ccattctgct 167941
atcctaccac gcgcgagacc cccaagtccc gcggcccacc tcggatggat acgataaggg 168001
cactcgtctc catagacctc ttcgctgttt cgccggggaa acgggatcgg gcgagcggat 168061
cctgctcctg cgccggtgat tggcaacctc ggctctgtct agagcgggat gattttagat 168121
ccgtcattgg agtgcgcccc ttggggtgga caatggtcag gctgctgatt tgccagtctg 168181
ccggatgtgt tgatcctcga actgttggtg aatgcctgcg cacggcagcg ctcgatcagc 168241
catgcccgat gctcaccggc gatcgcccgc ggcttgtgcc cgcccatctg gccggcggcg 168301
gcgctgcccg tctcacgcca gcgccgttga tcgaaagtca ttgtcgatgc cgcctcggtt 168361
gcggtggccc gccgccaccg acgcgccaag accgatcggc tcgatggcga ggtactggtc 168421
cgcaccctga tggcctggaa gcggggagaa ccgcgcgttt gttcgatggt cagggtgccg

Figure 3 (Cont.)

168481
acgccggagg acgaggatcg tcgccggatt ggccgggagc gcaaggcgcg ggtcgccgaa 168541
cgggttgtcc atgtcaaccg catcaagggc ctcctcgtca gccagggcat gcgggactac 168601
gagccgttgc gccgtgatcg gcgtgatcgc cgggacgaac ttcgcaccgg cgatggccgt 168661
gctccctgca tgaaggccca gatcggccgg gagctcgacc gtctcgaatt gctgctcgaa 168721
ccgatcaagg tggtggaggc cgagcgggac gcgctgttgg ccgtaccggc ggcgaatacc 168781
cggcgccggt gacggcgatg ttgctggacc tcaaagggat cggtccggag ttcgcggccg 168841
ttctccgtgc ggaaggcctg ttccggcatt ccggcaaccg gagacaggtt gccgcttatg 168901
cggggctggc gccgtcccca tggcgcagcg gatcgatcga tcgcgaggaa ggtgtctcaa 168961
aggcaggcaa tccgcggctg cgaacaacga tgatccaact cgcttggttg tggttgcgcc 169021
atcagccggc atcgaatctc ccccgctggt tccaggaacg ggtcgcgcgc aatgacggtc 169081
gcctgcggaa gtcggcgatc gtcgcgcttg cccgcaagct gctggtcgcg ctgtggaaat 169141
atgcgaccgc cggcgttgtc attgaggggg cggtcatgaa accagcgtga cgacacatcc 169201
caatgccgat tccgcctaaa tcatcccgct ctaagagttc aagccgtctc cgcgagctcg 169261
atatacatca tgccttccgt ccataagcat gggcggacgt tgctcgattc gaactttcaa

gtctgccaaa gcgccgggaa ggatgagacc cttcggagta gcatcatctg ccgtgacaaa 169381
aactgggtca agcaccggac gacagcattt gaaatgaacg gcagcgtcct cgatttttat 169441
cgagggggaa aaatgaggtt cgcttccatc acctcggata agaacgatct tcccaccaag 169501
aggctgaggg taggaggcaa aaacagtgaa ggctgttatc ccatcccgca gtccttcgtc 169561
atctaagaat agtgcatgcg agtcatcaaa gcggatcatc tgcaccagtc ggcaaccgag 169621
cagactaaag attggcgcaa gtccggtgcc gtcggcaacc tcgacggtgc gaaagagtgt 169681
cgtctccggg tctaagaggt atgcgacatt cttcatgtcc cagcctttct cattgtcata 169741
aatggcgtga cccaacaaaa ggcatccgtc acaggatcaa acagcggcgt gaagcgcaca 169801
tcgggtggtg tttcgctatg cagcatttgc caagattggg aaaatcgatt ttctgtatgg 169861
ggcctatcca caccatggaa tgtgggacgg attgcgttca agcacatcag tgtattgcgc 169921
ttttggtttt aattcacgag tgactgcgtg tgccggtcca gtcggacaat gattccgaaa 169981
cgaagcgggc cacccatttc gatttcattc cggtgattcc gacgcgaagc cggacagtat 170041
tggtgagccc tgggtcgttg cgatatgcgc agttggtgtt gcgcaatgat tcgtctgctg 170101
acatcactga gctcaacgcg ggaggcattg cgaagccagg ctgcaacgcc atagccgagc 170161
ttcttgccac gatggcagat gacaagcacc gattgacggt agaccggatc attgcaatca

Figure 3 (Cont.)

170221
tcgcacgcga aggcgcttct gctcgcacag tggatgggag cgagcggtcc gtcaagcgcg 170281
cggatgactt ggccgatcat gatctcggag gccggcttcg agaggcgaat acccgccatg 170341
tggacccttc ttcgaacgca gagtacattg cgaagctcca ggaggatcgt gtcgaggaac 170401
ttcttcggaa ttttgttgcg catggcgatt tccgtcacga acgtcgttcc tggcaggagg 170461
cggacttttc ccgtctgggt gccgatcaga cgctcgatat caccgccgaa gcggggctca 170521
ccccggcggt cgccatttga ttgctgaccg taggccgccg cgtcaagaag gtcgacgccg 170581
gaggcgcgag ccggggcgtt gaacgccctc tcgcggtaca cccgaagtct ctaatcggga 170641
atcaacttgc ggcatggtac ggtagtcatc gagatccgcc tccttcagca agttccaata 170701
atcgaccaga cgccaagggc tgtttgtcac gattcggcct cggtcgttgc ggaaaaaggt 170761
ggacataccc tcatggctcc agatcatctg ctggtgcatt tgttggattt tccggttgta 170821
atgttgatat atatcttgcc ggcattctac ttcgacaagt ctcttctcgc ccatctggcg 170881
cagaacactt agtacataat cgatttggct ctcgatcgtg aagatgaagc tgccgcgatg 170941
gccgagcgcc gtattgggac catagagcat gaagaaattt gggaaccccg ccacaacggt 171001
gccaagataa gcctgacagt catcatcgtc ccagacgtcg cgtaccgtcc gaccattgcg

Figure 3 (Cont.)

171061
tccgattacc tcaaccggaa gtagatatcg tgtcgtatcg tagcctgagg cgacgataat 171121
aaggtctgcc tcatgcgttt catcatcaat cgcatggatc gacctgccct caacacgcgc 171181
agcagctccg tctaccagcg taacatgcgg ctttagtagg gttctgtacc agccgttgtc 171241
caggagcatc cgcttgccga atggagggta cgacgggatg accttggcga taagatcagg 171301
gcgccccgcc agctgtccct cgatgtattg tgtgtaagcc tcgcggtcgc ggtcgttaac 171361
cgcattcacg gaacggtccg gatgcggcca ggccggatcc ttctgcaggg cctcatgcac 171421
ttcactgtcg taaatccaac tcaggcggag cctgtacagc cattcatagt gtggcacctc 171481
gcggaacaag aactgcatcg gttccgggac cggtttttga aatttcggga agggcgccac 171541
ccattgacgt gagcgttgga agattgtcaa cgcacccacc cgatctgcga tggcgggaac 171601
aacctgcatt gccgaagcgc cattgccaat cacggccaca cgtttaccgt cgagcgcgac 171661
ttctggatcc catttcgagg tgtgcaccac cgggccgtcg aagttgcgca ggcccgaaag 171721
gttgggccat ttcggcgtgg tgaagccccc cacggccgag aggaccacat tggtcacgag 171781
ggtttcctcc gtgccgttgg gcaggcgtaa ccgggagtgc caagttaggc tctcttcgtc 171841
atagcgggtg accaggcact ccgtgccgta gcggatggaa ctctcgatcc caaagtcgcg

ggcaacacgg ttgaaatagt cgtcgatttc cttttgcaac gggaagaacg tgctccagtt 171961
gccactggca aaagtgtacg agtagagatg ccccggcgtg tccactccac agccaggata 172021
gtgatgtgcg tgccagaccc cgccggtgct gtcttgcttt tcgacctgga tgtaggaaat 172081
gcccaattgt cttaaccgaa ttgccgctgc gacaccggac atgcccgccc cgatgatgag 172141
tacacgaaat cctttcggca aggacacggg gtccggaatg gcgcctgcat atctccgtag 172201
cttatgaagc atcatgtcag cgtattctgg cgggataggc tcggcctccg acacagtcag 172261
catgcggatc aactcttctt ccgacaggtc ctgcttggtg actggtgcgc cgctgtgcca 172321
acagatgatg gcgtccagtg ctgcattacg aatctccgtc tgtaattcgg ccgcgaggcc 172381
ccctgaatcg ttgtcgcccc agacactctt tacgggaaga aacggtgggg tgagccagta 172441
ttcttttccc gtgaactgat acagaaggag taatagggtt ggaacattgg ccgaagggag 172501
tgcctcggcg atgcggtggc ggaacagggc gaggtccgaa gagtgagcca tgatttaagt 172561
tcctcctgtt gcatatatcc actcccccgc cagacgctaa gtttactgcc tcggcttcgg 172621
cgtggttgcg gcaatcggca ttagggaaga tccgacaagc aagctgccga atgtctgatc 172681
caaatcgcgc ttgataaagc gagtcgaagg tcgccacggc ggggaggttc tcgggcgccg 172741
tcgtgccgcc ggccccggct cgactgcgaa atatgcccct gtgctgcctc ggctcgacca

Figure 3 (Cont.)

172801
ggcgcgcgca gccggttacg tctgcatctg aaacgatcca ccccttgatg atcggaaggc 172861
gggctcggca gaaaccattg gctaacatgt cgaaatctct gcgcgataag gtgggtccgt 172921
gacgtgtcct gcaaatgcct agaagcaata tgcgtgccaa aagcaagaac tcttcttaat 172981
gcaacgaaat gactcaagca gcggtctcgc gtgtccaaca ttgtcgtaca tcggacgagc 173041
ctcaacctga cattaattgt aacactgtat gtctgtcttc gtggccgagt ggctcgtcct 173101
acactgcact tccgaggttg ctcggatgag ccgacccaat cctaatcata ggaggacgag 173161
ccgtggcaga ttatcggcta cgccgcatca gcgtctggtt gccgatgctt ggacgtcaga 173221
tgtagcccgc tcccgtccgc aggaaatcta cgccgggcta gatcctgtcc tgctatttgc 173281
gcgatgtccg caccgtgcag gagcggctcg ctgcgcttgc cgacactccg ccggccatgc 173341
gctctgacgg ggtagctcag ccgatcgacc ttttcctggc gagcttgcgg acggcctgga 173401
aggacggagc tacccggccg acggatcgtc cgattgtaaa agccaaaaga ggacggcggc 173461
gtcctgaccc tctcgtcaag gcgaccgccg acttgcgaag ttggttcgaa gccgaaccat 173521
ggcgaaccgg cagcgaattt ctgtcacgcc tgcaggccga gtatcccggc gattaccccg 173581
acaagctgct tcgaacactt cagcgccggc tgaaggtctg gcgcagcgaa caggcggacg

Figure 3 (Cont.)

173641
cgttgctgtt tggcaccttg aacaaggagc tgccggccca gcagatcgca aggccacact 173701
gaggcgacgc cgtggcgctc gcgaaggagg ccaggcgctg cgaaacccct accatcttcg 173761
cgcccggcct ccttcgcccc aacgcgggaa caaaatgaat gaggcaacgt gcgaatctcg 173821
ggaagcatcg ttacgtgcgg caatacggat gtaccagatt gtcgctccac cgcggctgca 173881
tgtcggttac aactgggcca gcggccaggg cgcggggcgg gaagctgcta cgcctcaatt 173941
ccgaccgggc gagatcttcg gccgatcggg cctgcgcgcc ccgcgatctg cggccggtgc 174001
tccaccaagg cgcagaggtc atcgtggagc accggctgga actcgctgcg cctgttgcat 174061
cccgagggcg ccgccatcga cctcttttcc gcacttggct caggcggagc aggaaggcga 174121
agtcagcgtg cgcatcgacg aaggcgaggc gccgctgagc cgctggtccc agagtctctt 174181
gacatcactc ctggtcactt tctgttttgt ttaattcacc ttctgcaaca cgtgaatggc 174241
tgagccggcg tcgtctgaga gcacatctat tggcacaaaa cccgctcggt gtgcacattt 174301
tttgaaaaac gactcagaga aacaaaaaga gttcttcaga tgcagtcgct cgccacttaa 174361
taggatgata tccttgccgc caatgcaaaa gtccaggttc tttttgacca ccgctgtatg 174421
tatgacttgc atgaattggt ctccgcctat aacatccggc tcatactcaa atgcctctgg

atcgaaattg ccgtcgaccg gcagctctgc cttcattcta tagaacacat ttagctgaaa 174541
ttcaggatgc gcttcatagt aggacttcgc gacatccctc ctcaaatctg agccaattga 174601
aatcgcaacc cagcacctct tcgcactatt cgatatcttc ttcagcgtct cgacgaccgc 174661
ttccatgggg tgcgtatcat ttgttgggac agcaagattt ccaaatgtcc ggccaaacat 174721
gacaataaat gccgcttcat cgtcgcaaaa atagcgtcgt ccagagaata tatcgccgcg 174781
tatgaactcg attttcaacc ctaaagcgga tgacaattgt gctatgtccc cgaggaattc 174841
tcttgaccgg tcgacgagcg tgcaacgtga ggtttcgcct cgcagaccta taacaagcgg 174901
aagcgttttc tgttggaagg ctcgcactgt tccaggccca tactccagaa ccgaaattcc 174961
tttacgacat cgttcgtcct ggtgatgcca ttgaacataa tctctgactc tcccgtgaag 175021
tttttgggct aacttgagtt cagcatccac catattggtt gtgccagtga cgagcgcact 175081
actgatcctc tgggcttcag ccttagccca taacaacgcg ccactcattg gattgccatt 175141
ccggtcgact ccagtgtggt gagcgtattg ttcagcacct aagtcaggcg catacttttg 175201
ccgaaacagc tgcaaacttg tttcaagaaa gctcaagctt atcgcctctc gattctttaa 175261
cggctcgtcg gatccccagt tgacgcactt accgccgcaa acgaagatgg tgcgcgtagt 175321
ccatgagtct gttcatgggg tgttcactga acccatagga gaggctacag ggttggaagg

Figure 3 (Cont.)

175381
agtaatcctt gacgtggatc aaagacaaac ccgaatctgg gaggggcttg aacaaatgac 175441
gctggaaggg gcgccctgtc gatcactaca cgatctttcg ctgggctaga aatacgcgcc 175501
ggagatcgaa aagcggctgg gttggcaccg gcgtcggctg cagtcgacaa gttggcgcgt 175561
gtgaaagtcc gtggtcaatg gacatacctt taccgcgccg tcgataaaat tggcagcacg 175621
atcgactttt tatctgtccc cggcgagccg tcgatctgaa tgagttcgcc gaagcaatcg 175681
cgccggccgc gcggctggaa aacccgcttc ttgcgttcgc gtcgcaacgc ccagatgccg 175741
gcttccataa tccactgacg cagcgtctcc ttgctgacgg caagccggtg gcgttcgatc 175801
agcttctcgg ccgccagcgt cggtccgaaa tccaggtaat gctcacgcac caggtcgagc 175861
accaggttgc ggaattcctc gctgtggggc tatatttccg gaaggccgcc agccaagtaa 175921
tgaaatgcaa cgcgcttgtt cagccgagcc gcgcaatctt catggagcga gtttatccga 175981
taccatttag cgttgattgt agacgcaaag ttgctaatct cgcgttcaaa tggaaggggc 176041
ttttatgaaa actatggttg caatgcttct tgcagcggtt ggcgttgcag tcagtgccag 176101
cagcactttg gcggttaatt tctgccagtc caacaaagac cggaattgct ttaccggcag 176161
tttcggactt gtcgacattc ccggtgacgc aagccataag ctgctcaagg cagatttcgg

Figure 3 (Cont.)

176221
atatgtcgat ttgaacggag tgggttggca gaccaacaag gagacgaaga ctgacggcgc 176281
ttcgattccg ccgctattgc aaccgtttgt cggttcccca tgggaagacg gctatattcg 176341
tgcagccgtc atccatgact ggtactgcga cagacacgtt cgaacttgga aagagacgca 176401
tcgcgtcttc tatgacacca tgctggccag cggcttggag aaaccgaaag cgaaattgct 176461
gttctacgcc gtctatgcct ttggtccacg ctggggctat ctcgttcccg gagagaagtg 176521
tgcggctggg aagaactgca tccagatgac aggaaaggac gccgcgttcg tgcagttgcc 176581
tggggaattg gccgatcagt cgagcgcagg cgaattgaag gcgatcaagg cgaccatcga 176641
tctcaaggag cgttctggtg atgcgttaac gcttgatgaa cttatggcga tcgccgacga 176701
agctcacccc aagcaaacac ttcgtgatca gcggcctgcc ggtggtgatg agatcaccaa 176761
gtaacggtgc aagtcgtcga tggaggacgc gaggaagagg gaccgtcttt caagaccgac 176821
agcactatac gatcttgaga agcagattca tcgcttcaac cggcggccaa gttaggcttc 176881
gtcaactagc ggaaagtctc agttggctgc tgaagttcgc agcgcacgag tctttgctat 176941
ttccgatcta cgacaggctt tgcgaataat cgcgcagggc tccgaccttg cagtaatgtg 177001
gcaaggaagg agggacggcg tgaaaccagg gtgtagagcg aaggctcgtc ggtccgggtc

cacggcgcaa gccacacctg gcagttcgca cccgcggcgc cggcgagggt actgagaatt 177121
tctcggacca gagaggtatc aagtttggtg gtgcgggcga tgcctgcttc tgtgcgcaag 177181
tcgaaagcgg gatcgagaag agccgcgagg acggcgcgca caaagtccgg ccgtaagtcg 177241
gccgccggga gaggccagcc ttcgatctgg tcgcgcatca ccagctcctg caggagtgtc 177301
aggcggatat agtcgacgat cctattcctg ccgacgagca gcaggaagtt cagcccgagc 177361
ttcatgcgag cgctcgtcgt ctcggtgctg acaagacgcc gcgcgacggc gaccagtcgc 177421
gcctcgatgc gtttgaccag caatgcgaag gcgttttcgt ctattcgcgc ccagcgagga 177481
tagggcacct ccggcagggc atcgccgacg aggggaatga tcggtacata gtcatgcatg 177541
ctgccgtccg aaagggtctt gctgatcacc gcgtttcgcc gttcggctgc gccctccggc 177601
cagtgtagcg tctgatggtt cttgtcgatg gtgagatggc gcatcaagaa atattggcag 177661
ttacggcggc cgagctggta gtcgtggtcg cggaacgcct ccaggacgaa accgccgaag 177721
ccgccgagca aaccgcttgc gatcgagaag gtctcctccc gctcctcgcc gccgggcgta 177781
ctaggcggca cgcggtgtgg cgagatcatg aaccggctgt gggtgccttc ggcggcgacg 177841
gcgagcaact gatcaggctt gaagcgtacc tgctggcgga gcgccgtcac cacgcgcctg 177901
gcaatgctga gcaccccgag cggcggttcg ccatcgccga gaaaaggtgg cccctcggga

Figure 3 (Cont.)

177961
aagggcgcga tcatgataac ggctcgatcg gccttttcgg cgttccgttc attgggccgg 178021
ggcgggtcct tcatcagggt gaagcggaca aattcgaacg ggtcgttgtt gatgaggcca 178081
ccatcgacag agacgaacga aaagggatag tcttgcgacg ccgagacatg ccacgcgtcc 178141
ggccacgtgg gtattggtct gagctctgat tgatcctcgg aaatcggaaa cttcgccttt 178201
gcatattgcg aggtggccgt cgctatcacg cgcggtgaaa ggccaatcgg gaaggcgccg 178261
gaggcgaggg cggcattggc gaaggcaagc cattccggcg ggcgcgtcga cgcgcccgcc 178321
gcgccgaaca gtgacgtggc cgcgatcgac gtgcccgaat ctgtgtcggc gaaggggctg 178381
ggggtcggct tccacgtgcc gatgccctcg accacgtagt gcacgcggtc ggcgtgcgtc 178441
atcatgttgt attggccgcc gttgaagtga atcgcgtaag gcacgccgcg caagttcgac 178501
agcatcatgt agagatggag cgaactggcg acataggcgc gtgggctgag ggtacccgtc 178561
gcctccaacg cctcagcccc aatcgcggtc aacacgttgg cgttgagaac cgagatgacc 178621
ggccgcccgc ccgccaggtc ttcgagcgac agcaggtcgg gtgagccgtc gggggaaacc 178681
agcgtcgggc tggtcaccca ggaccggtaa agacgtccga gagtgaagcg gatgttctgg 178741
ctgccggggg cgggacttgg gaaggtcgcg ggagcctcgc ggccgccggc ggcgatcacg

Figure 3 (Cont.)

178801
ccaatggcgg cggtgatcgc gccagcagag gccccggaga gcgccttcag gcgaacgtcg 178861
tactccggca agtcgggagc accttccgcc ttcgcctttt cccatgcgtc gagtgcctgg 178921
atcagaaagt cgaagacgcc ggccgaatag gctcccgccg aaatcgcacc cgacatcgca 178981
atgccgattt cgaacgtagg tttagagccg tcggtcatca ctgttccctc agttgagcgg 179041
cgccgcattg atccctgcgg gcgccatgac gttcgtgcgc ggctgccgcc ggctgcttac 179101
aatgtcttca ggtatgcaat gagcgccgcc ttctcatccg gcttcaacgc cgggcctatg 179161
acgcccgggc cgggggtgtc gctgaattcg tgaccggcat tgctgttgcc cggctttgcg 179221
gtgtcgaact tgaagccacc cttcaattcg tccgttagat agccaagctt gtccgggtcg 179281
tattcgcgat tgccgagcca gaacgtcttc ggccgttcgc cggccgggga aagcagggca 179341
tcgatggtcg gcaccgagcc gttgtgcagg aagggcggcg tcgcccagat gccgtcgagc 179401
ggccgtgcct tgtaggcaag cggcgcctgg atgccgttct ggcgattgcc attcatgatc 179461
tcccgttgct cggccggcac cggcggggtc tggttgtcgt accagcgagc ggctgtcttt 179521
gcgacgagcg cgccgagcgc gctgccgaac gagtcggtgt cgatgccgag ctcggaggga 179581
agcttgacct tgcgctccgc catgctttgg gcctgggccg gatccgtgcc gatattctcg

acgttgatga tgggcacgcg gagatagcgc tcgccggccg aattctcgtt cgtccagtgc 179701
ttctgctccc aaaagccctc actgccgacc ggtggcaggt ggcagccctg gcaccggtcg 179761
gcgtaaactg cggcgccctc ggttgcgagt ttggtatcga tcgaaccgaa caggttggaa 179821
ggccaacgcg ggggacgcag gccggtgaag ccgttctctg ccgtcggttg cttgccggcc 179881
aactgctgct cgatctcgaa aatcgtgtcg accttcaccg tcgaggcaaa gagtggctgc 179941
tccgacttgg tgagattgat gaaggcgcgg acccccaacg cttcgcccgc attgcgcacc 180001
atcggctgca tgatcgaggc attgtattgg acccaatcga accaggacgt gtcccagata 180061
tgtgggaaag cgactggcgc ggattgagcg acgtagttct ccggccgctc aaggtcgagc 180121
gagaagacct ggttgccgat ccggttgagt gcatccaacc ggccgaaccc ctcttcgata 180181
ctttttttcgg ccaccttctt gtcgagatcg acttcgatcc tgccacccgc aagcaccttg 180241
tcgagctgtt tcttgagcac ggccctggct ttctcatccg cctgcggccc gagcactgcc 180301
gtggcgaagc ggtcgaaacg gaaaggcgca tagcgggtga agaacaaggc caatcctgaa 180361
gccttgcgga attttccaag atcggtgagt gccgggccgc catcgaccat cacggcagta 180421
cccttgtaag tgaagcgacc ggtgtggcat gccgcacagg tgagcccgac ggtggtgagc 180481
ggcttgccgg tcgccggatt gacccacggt tgggcggttt tgggatcgac aagatcgccg

Figure 3 (Cont.)

180541
ccatgggcaa agccgaccgg aaggccggat gaatccgccg taatgaagcc gaagcggtcg 180601
agataatcgc tggacaggaa gggcggcccg gctgtcagcg tgaaggtggg ctgctccaac 180661
gccgccagcc attcgtaggg catcgagaag gtcaccgtgc cctggtcggc atggtgcatc 180721
caaccgcgtt gtgattgtga ccagttctgc tcgagccagg tgaccttgtc caccttcgga 180781
tagtcaggaa gatcgacgct aaacatccgg accacataat agaggccggc tgcgaccagc 180841
acggtgaacc cgagcaggat aggccaaaat cgcgacttgc gtttcatgcg tctttacccc 180901
caaagcttga aagcgcccct tccagtgcgg cgtggtcctc taattattct ggggcggcgg 180961
cactgccgcc cgcgccgctc gcgcgcccgg atagacgatt gcgcgtgcgt gaccgagcga 181021
tgcgtaatca tctggactgg tcgccaaagg aatgcgaatg cattccgggc tccggtttgg 181081
attcatctcc agcctgctca cggccgcctg gtcgtcgatg acctcgttaa ggcgaatttc 181141
gaacatgtcc acccagggga accagtattc gttccacggc tgggacgggt cgaacagctc 181201
gtgattgccg accggcggcg gcggcgtgtc acgcagctgc gcctgcagga tgtagcgcac 181261
gtcactgtgc ctgacgcggt gaatgaaatc cttgcgcagg aagtcgggag cccgatcgtc 181321
gtcagcctca gcgtccatgg atggatggcc gttagccttg aattcggggc gcggcagacc

Figure 3 (Cont.)

181381
gcgatcgggg ccgcggtcgg cgttgatcag ccggaagcgg acgtagcggc tgacgccagt 181441
tttgtcgatg aattcgaaac agacccaggt gtgataccgc gaatccgtga acgagccgcg 181501
gatccgatac gcctcgcgta gttgatcatc gagcatcaat ccggactcga ccagctttat 181561
tcgttctgcg tccggcgtgt ggacgaaagt cgagaagtcg cggatgctgc gcacgaagag 181621
ctgccggccg gcattcatca gaacgtcata gaatccgtcg ccatcggtgc tggcacctgg 181681
ctcgaaaaat tttatcgagg cggcaacccc atcgcgtgcg cggtcgtcgg cgcgaccgcc 181741
cggcgaggaa tggcgcagga tgatcgggaa gatacggcca ggcacgaaca tgtcggtttc 181801
agggaaaccg gccggcgtga tgcagcgcgc ctcgcctttt gccacgaccc cgtaggtgtg 181861
cgtcgcacgc ccctgctgaa gattggcggc gtcgcctgca gcttggcaag cacggccttg 181921
aagtcgtcat ttatgccggc ggtcagttcc tcgggtgaaa ggcgcatgtt gaagctccag 181981
tgttcgttgc cggtcggctc gcggcgaacg acctggttgg tctcgtgccg gaggccggag 182041
ctgctgagat agacccgccg gcggacctcg ttgatctcgc caagcggccg gtgttcaagc 182101
aaggcgtgcc acggcgtgaa ggagaggttg tccccgaagg cgagctgcgc cgccgaggtg 182161
aaggtctgcg gtggtatggt gatgcgggcg accgcctcga ccggtgtcgc ccattcgacg

gtcgggttgt cgatggtggt tgcacttgtg tcgtcgttga gctggacgcg gaagtcgaag 182281
accgccggtc gcgccgcccg ggtgaggtga tcggtcatcg cttcgcggag atagccgggg 182341
ccgcgggcct cggagggaat ggacgagaca aggttgtcct ttgagggaac cacggaatag 182401
cgacaggcat gcgcattgcc caatccgtaa gcatagggca cctggctcca gtagcgtgca 182461
gcaagcgggc tgtcctgcac ctgctggcgg aagccgagaa gcacgggcag gtcttcgggc 182521
cggttttcct tcaaccatgc gatgaaggcg agcggcggtt caccgcgagg cgccgaccgc 182581
gcgaattcgg ccatgaaccg gacatagtcg ctggtgtttc tgatgaagaa caccggcttg 182641
tccgccagca cgaaatcatg ggtggcggcg tcctcctcgc cttccagtat ctttcggcca 182701
gccaccccgg tcagcttgat cgccatgccg tgaatatcag gcttggtgtc gtcgatctga 182761
gcgccgttgg aaaagcggat ataggccgtg tagaccttcg gctcggcgaa aagcccgacc 182821
ctaaggcgct cgggaaggtc cgcaagcacc tcgaaggtcg caaaaacgca gccatgctgt 182881
ttaaagtgct ggccacgcag gccggggccg gtgccccgca tcagcagccg ctgcaactca 182941
tcgatttcag cgatcccggc attgacgtcg gacgaggcag tttcggtcat tgcgccagtg 183001
ctccaagcta tcagtggggt gaacgcgagc ccgcgctagc gggtcttcag atattcgatg 183061
aggtccttga gggcatcggc atattgcggg ccactccagt cgagtcgacg gagcttgcca

Figure 3 (Cont.)

183121
tcgaccacga gattgcggtc gtggcccgtg ccagcatggc cgtcctttcg cctgtcgtag 183181
atggtcagcg tcggcgacgt gtcggcaacg aggccggtaa cggccggatc caagacatat 183241
ccgactttcg cagtgtcgta ttggatggcg ccgcgcagga attgctccgg gcggctcgcc 183301
ggcaccagga gatggtacag cgtcggaatg gaaccattgt gcaggtaggg cgcgcgcgcc 183361
cacaccccgt caagcacctc ggcgacatag ccctggaccg ccggcgtcgt gcgggcggtg 183421
atcacgtcct cgcccgccat ccggcaggga cggacttcct cccccgtcgg gctgcgatag 183481
aggaaatcct gatcgtggca gcttgcctga aagccggcgg cgaaaaggtg aaacgccgcg 183541
tcattgagga cggccgcgcg gttcatgtcc gtgcctatat cgcggaactg gtagattgtg 183601
tcgttgtgcg gcttgtggca gacggcgcaa ttgtctttga atagcgcttc gccgcgcacg 183661
gcgctcgcca tgtcgacatc gaacgggtag gcggccggtg gcaggccgtc gaggaaattg 183721
gcgacaacgc cggtattgac gagatcgatc ttggaagggt cgccgacgat cggaagctga 183781
gcggcgatgt tgcgccagaa cgccatcttc acgctgccgt cccactgggc gagcgaacgc 183841
tcctgttggt tccacacgct cggaatgtcg gtgatggtcg caaatggtgg gatttctgga 183901
tgcgaactat tcttgaatgc cgtggcatcg aagttccggt tgaggccccc cgccgcgttc

Figure 3 (Cont.)

183961
ggctgacatt cgccgggggg cattgccttg gccaccaaca actggaaaat gagatcgccg 184021
ctgccatcct gctgtccggt gctgaagccg gaaaagccag gtccgttcca gttgccgtag 184081
ctggtctgtt tttgaagctc gatcccggct tcgcgctgaa cggtaccgca agcgaacgtc 184141
gccaaaatgc cgggaagatt ctttttaaa gcggctcgtt gagcgacttc gacattcggc 184201
gtgaaattca ggaatccagg tttgccgaaa taagccggag gatagaaata cccgttcggt 184261
ttggcatcga tgatggctgc gatgcgctcg gccgacgctt ggatcttttc aggggtggag 184321
aagtaggctg tcaccgttcg cgagtaggca tcccgccact tgcgcacgtc catcttcgtg 184381
ttcggcgcac cctcgacgac cgccggtcca tccggcgtct gtacctgtcc aatgtggccc 184441
gcaggcaagc gtcacgacat cgagcccggg cttggcgaaa tcaatctctc ctaacggatt 184501
gccgccagca tccagggggc ggcccgcggt cgaagcgatg ccgagcccga gcggcagcgg 184561
ccgcgatttg tcatccggat caggaaagaa gccgaaacgc ccgaaattct catcgtttcg 184621
cccccaaatt tcgggtgcga gatcgggtaa cacgcgctgg agcaaatacg gtgcgccagt 184681
aaagccattg cccgcattcg cgaaccacga cgagccgacc ggattttgct ctcggtaggc 184741
ggtccgttcg gcatcacacc cagcgcgaat ctctgtccaa ctgattgtca tattcgcact

caggtcatct cgcgccgaac aggcggggtt tgctgcagcc agcccgtggc tcccgaggat 184861
ccagagcgac gcaccgtacg ccaccgcaaa aaagtgcaaa gcaaaaggga gacgttcccg 184921
acagtgagac ggcattctaa cctcggtctt tgcttgcaag gagcagatga attgggcaga 184981
ctttaagaaa ggctgtcagg taatggcgcg cccagatgga aatccccgcc gccgttttac 185041
acgcataagt attagcatgg gctgggagga ttgcaagcct caaaggagag gtcttttgcg 185101
tgttctttag cttgacgctg ctgctttcct ttaggttacc aatgaattaa gtaccggaca 185161
atttctccac gagcagggca acaatattca aggatagatt tgtccaggtg tcggccaaag 185221
gatgttatta taatactaat tcgacttaaa cgcgatctcc gggtcatctg atagatcgga 185281
atataatcat ggcgcgctgg cgccgagttc accagcaaga cgcagagcgc cagccacgtc 185341
aagccgctcc aatccagacg atatcgtccc gcggccccct catatgatga gttgaaggtc 185401
aagagggtgg gggcaccatt ttgcaagcct ttctgtcgtc gacggtatcc agctgcgccc 185461
attcccagta ctggcaggcc atgcctcacc tgtaccacct catatccggt cgccgctcaa 185521
gacggctgca ccataatccc gcattcgggg gtgggctcag gagaacggaa ccattctttt 185581
aggcggcgat agaagccatg gggggcttcg gtccgttcgc ctggatccgt cagagctgtt 185641
caggctccga gggattggct tggtcaaaag gtgggtggtc aggccttgcc catgacggct

Figure 3 (Cont.)

185701
ccttcgatca cgacaccgct ggtcgcatac ttccacaagg ccacgagcag tttgcgcgcc 185761
agcgcgacga tcgcaacctt cttgccacgc ccgccgctgt ggctgatccg ttcatagaac 185821
cagcgcgtca gggccgagcc cggctggtgg cgcagccaga gccaggccag ttggatcatc 185881
atcgtccgca gcctcggatt gcctgccttc gagacacctt gctcgcgatc gatcgagccg 185941
cttcgccacg gcgaaggcgc gagacctgca taggctgcaa tctggcgccg gttgtcgaac 186001
tggcggaaca atccctcact tgccaggata tttgcgaact ctgcgccaat gcccttgatc 186061
gccttgagca ttgcctgggg cgcggtacca tccaccttgg cacactgggc atcgcgctcg 186121
gtctcgacag ctttgatctg ctcgttcacc aattcgaatc gatcgagctc acgactgagc 186181
tgcgccttga gatgggcagg caattgccgg ccatcccccg tccgtagttc atccaagcgt 186241
tcacgccggt cgcgacgcgt aggctcataa cctcggacgc caacgctgaa gagcagtcct 186301
ttgatccggt tgacgtgtct tttgcgctcc tcgatcagcg ctttgcgctc tcgcccgatc 186361
ctgcgacgat cttcatcgtc aaccgccggg actcggacca tcgaacaaac ccgcggttcg 186421
ctccgcatcc acgccatcag cgtgcgaacc aacgtctctc cgtcaatgcg gtcggtcttc 186481
gcccggcggt gccggcgcga caccgcatcg aggccgcatc cacgacatgg ctcgtgatcc

Figure 3 (Cont.)

186541
agtcttccgc ctcgagcgcg cggtggatcc agaaaccatc gagccccgct tcttggatga 186601
caatcagggg atagagcctg ccctcgcgcg cctctgcctt ctcgcgcaag aggttcaagc 186661
atgccagcaa agcaggcaag tcaccgccgg gtaccgaatg acgcgacatc ttctcgctgc 186721
caggcgatag cggcgtcact agccagatcg acttcgacag ttccaatgaa acgaaaactg 186781
cgtcaagatc aacccggata gcggcaggtg gcgaagctgg ttctgctgtc atggcaagtc 186841
ccttcagagt ggttggtagc aaaccgactc tgatctctca caggccgctg tccaccgctc 186901
atcatggaat ctttcgagtg aaactccgct ccgggaaagc gccaatcctt gagtttgatc 186961
ccttgctggc aggcggcggt gagcgaacgg tccttggcgg cctgaaaacc aagaatgtcg 187021
acgtcgtggt cactcgagaa ggcatcggac cggttcttgc cgtttcgtgc aaggtccgga 187081
atctgacgaa ccgcatggaa gagaccatcg gtatagcgcg gcgatcagga tgagacggcg 187141
gcgacaatct ggatgagact cttatgtcgc ggtcggcatg aaggtatcat gttgattgtc 187201
gctggcaagg gtctcatcgt gttctgattg tcgctccgcg acaatcaggg aagcactttt 187261
ggttgtcgcg aaggcggcgg gtctgccgcg gtggcgtttg gcttccatgg cggaacgtcg 187321
ccgatagctt tcgacgttca tttcgaagat cgttgcgtga tgaacaagtc ggtccaccgc

ggcaagcgtc atggccgggt ccggaaagac gcggttccat tctccgaagg gctgattggc 187441
ggttatcatg atggaacgcc gctcatatct tgcggagatg agttcgaaca gcacgctggt 187501
ttcggcctgg tccttggtga cgtaggccag atcgtcgagg atgagcagat cgaacttgtc 187561
gagctttgcg atggcggatt cgagctggag ttcacgccgt gcgacctgaa gcttctggac 187621
gaggtcggtc gtgcgcgtga acagcacccg ccaaccattc tcgatcagcg cgaggccgat 187681
ggcggcggcg agatggctct ttccgccgcc cggcggaccg aacaggagga tattggcacc 187741
tttggcgagc caactgtcgc cggcggcaat ggccatgacc tgggccttgg agaccatggg 187801
cacggcgtcg aaagcgaagc tctcgagcgt ctttccgggc ggcagatgcg cctcggcgag 187861
gtgacgttcg atcctgcgat gcgcccgttc agccagttca tgctcggcga tggccgaaag 187921
gaaacgagcc gcaggccacc cttcacgatc ggcctgttcg gcaaattgcg gccacagcgt 187981
tttgatcgtc ggcagcctca ggtcattgag catgatgccg aggcgggctt cgtcgatggt 188041
gttgtggacg tttttcatgc ggcctctccc gcataagcag accccatcag ggcttcatag 188101
ctattgagcg atgcgagctg cacatgcacg gtcggcaact gatccgggtc cggaccgaag 188161
atggctctca aggccatcag gtcgggcagt ttgcgggcgt cgagcgttct ggcaagctcc 188221
tcggccagtt cacgctcgca accgcgatca tgagccaggg ccagcaattc gacggtgatc

Figure 3 (Cont.)

188281
ttgcaagcct gccggtcagg cagttgctcg atgagagcgt cgaaagccct gcgatattcc 188341
ggccggggga agagcttgtc gcgatagacc aggttgagaa gcgccatggg ctttttgcgc 188401
agagagtgga tgacgtggtg atagttgacg acctggtcat gcttgccgct cgcgtgggcg 188461
cgacctcgtg gcaacgtcag cagatgcgtg ccgccgatga agacgtcgag acgatcgtca 188521
aacaaacgca cacgcagccg atggccgatc aaacgggagg ggacggtgta gaagactttg 188581
cgcaaggcga agccgccggt gcgcgacacg gtgacgacta cctcctcgaa gtcggtggtg 188641
cggcgctcgg gaagcacctg cagatgcggg cgctcggcat caatgcgctt gccatgcgcg 188701
gcattgcggc ggctgacgat ctcgtcgatg aaggcgcggt aggagcgcag atcgtcgaag 188761
tctctggtgc cgcgcatcag gagtgcatcg cggactgcgt tcttgagatg gccgtgggag 188821
ctttcgattg agccgttctc gtgggcgacg cccttgttgt tgcgcgtcgg cgtcatccgg 188881
tagtgagcgc acagctcctc atagcggttt gtcagatcga ccttggcatc ggcatcgagg 188941
ttgcggaagg cagccgacag gctgtcgctg cggtgataga gcggcgaacc gccgaccgac 189001
cacagggcgt tctgcaggcc ctccgccaag gcgacgaagc tttcgccgcc aaggatgaca 189061
tgggcgtgct caaaacccga ccaaaccagc cggaagtgat agagcagatg gtcgagcggt

Figure 3 (Cont.)

189121
tggccggcga tcgtcacgct gaggctgccc atgtcggtaa aatccgacag ccctagtcgg 189181
ccgggctcgt gcgtctggcg gaagatcacc tcctgtgctt caccgtgaac cgcccgccat 189241
gaccggatgc gccgctcaag tgtgcggcga atgccttcgg gcagttccgg atgacgccgc 189301
agcatctcgt cgtaaacggc gaccgcacga atgccgggag cggccttgag gagcggaacg 189361
acctccgcat caaagatatg ctcaagcgga tcgggtcgac gccgaccgcg gggcggcttg 189421
ttctgcgacg gaaggcgctg ctctttctcc atgcggaacg ccgtcgcccg gctgatcgac 189481
gccttcgcgg cggcgacctc aacagaatgc gtttgtcggt acttcatgaa taatctcatc 189541
tgatgatcgg ttacatggcg acccggcaca aaggtggttc tccattccag aaaaccgcca 189601
ccgtagcggg ccgaccgcga tcatgagacg cctaaaaatt gcgccgcggc gggggtgtaa 189661
ctccggtcgg gctacgccct cccttcgtca cacccccacc gccgagtctc atcctgattg 189721
acgctgagtc tcaccttgtt tgtcgccgcg caccatcggc gagtgcacta acttgcacat 189781
cacctatccc gcactcgtgc tgggatatct cgttctcctt cgagcaaacc ggatgatcga 189841
agcggcactc gatgacgctg cggaagtcgc cgaagatgcc ggcgctgtga gcgggacaaa 189901
aacactacgc tatgaccgaa ggcggcgcac cggtggcagg catcgttcgc ttccacaacg

ctctgtgtga actcttcggc cggcgaggca tccgtgacaa cgtcagccgt tacgaggcga 190021
ttggcttcgg tctcgtcgag atgcatggcg aggagcgcaa cagcctcctc gaaggtctcc 190081
cgcaatcgga cagtccattt cggctgagtg ggtttttga cacgctctac gctcgttacg 190141
acgagcgctt cgtcgttagt gcaccgtgag cgtcacgaac gccccacctt ttatcggcgt 190201
gatttaggcc tgagattcgg ctctttgatt tggaagggct gttttgaatg gacgagcgga 190261
acgatagtgc caggtctgaa gccatgtttg aagccaggca cgaagggcgg tatcgccgtg 190321
ttgaggtgat cacggggcca gtccgccgac ggaactggac ggacgaggag aaggctctga 190381
tgctcgcgga aagcgctgag ccggatgcga acatctctgc cattgcccgg cgctttggcg 190441
tcaatcgcgg ccttttgaac acgtggcggc gggcggcagg ccaaattggc ccggttttgg 190501
gagagcccgc gctggagcaa cccgctttcg ttccgatcag gatcgctgac gatcagaatg 190561
agcatcaagc tgatgaagca ggtatcgccg aaggcgccgc cggtcggatc gagatcgagc 190621
ttggcggtgg gcggatgatc gtgacaggca atgtctctcc cgacttggcg catgctgtgg 190681
tgatggcgct gcggggtaga cggtgatcgg gccatcgagg gggctgagga tcatggtggc 190741
gacccagccg gtcgatttcc ggcgtggcat gaacgggctc gtcgcactgg tggggtcggc 190801
ccttttggcc gacccctatt gcggcgatat tttcgtcttc cgggccaagc gttgcgaccg

Figure 3 (Cont.)

190861
gctgcgctgc atttattggg acgggtcagg catgatcctt tcgacgaagt ggctggaaag 190921
cgggaagttc atcttcccgc cggtcaagga tggcgctctt cacatgtcac ccgaagagtt 190981
cagtctgctt gttgcgggcc tggactggac acgcgtcaag cgcaagcccg tgaagcgacc 191041
aacgaaagtg gcttgatctc attgtatttc cttgcagatt cacgcccgtg tggtagcttt 191101
cggcatgtct cttcgccacg aacagctccc gcaagatgtc gagcaactga gcaggatggt 191161
cctcgatctg agggcggagg tcgcctacct gaagcggctg atccacggcg caagatcaga 191221
ggtgctttcg acgatcgatc cgacgcagac cagtcttgat ctcggcgatc tttcgactgt 191281
tccggtcgcc gccaacgacg accagcctga cggttcccgg cagagtgtgc gtggccggca 191341
atccgcagcc cgcaatatcg gctttcttcc gaagcacctg ccgcgctacg acgtgattat 191401
cgagccggaa agccgcgcgt gcgcctgttg ctccggcgcg cttcaccgca ttggagagac 191461
gacaagcgaa gcgctcgata tcgttccggc catcttgcgc gtcaaacgaa ccattcgccc 191521
tcgctatgcc tgccgggcat gtgagaatgg tgtcatgcag gcgcccgcac cggcgcgctt 191581
catggatggc ggcatggcga cgacggcatt ggccgcccat atcgtcgtct ccaagttcgc 191641
atggcacttg ccactctacc ggcaagccca gatcttcgca ggctatggaa taaccctcga

Figure 3 (Cont.)

191701
tcgcggaacg ctcggcatct ggggcacgcg tgtagcctgg tggctgaagc ccctctacga 191761
caggctgctg gccttcattc gctcgcagcc aagggtcttt tccgatgaga cccgattacc 191821
gcggcttgac ccggggcgaa agagaacgaa agtctgccag ctgtgggcgc aggcggtgga 191881
cgaccgcccc tggaaaggac cggccccgcc ggcggtcggt tacatcttct ccgagagccg 191941
cagcgcccgt gaggcggaac gccaactggc atccttcaac ggcgttcttc aggtggatgg 192001
gtataccgcc tacaagacgc ttgccagaca tcgcggcaag agcaattcca gtcccttgag 192061
gctggcgttc tgcctggccc acgcccggcg taaattcgtc gatgtggtca agttgaccgg 192121
atcgccggag gcgctggaga tcgtatcgat cctcgccgag gtctaccaga tcgaacggga 192181
gatcaggggg caaagcgccg aggatcgtca gaatgcccgc cagctccgct ccgctcccgt 192241
catgcgccag ttgaaggcgc gcctgctcga cctgaagaac gacatctcaa cgcagtccgc 192301
cctcgccaaa gccatcaaat acacgctcgc gcattggacg ggcctgaacg ctttcctgga 192361
cgatggaacg atagaggttg actccaacat cgttgagcgt tcgatgaagt ccgttgccct 192421
gacgaggaag aattcgatgt tcgtaggcaa tgtccagggc ggtgagacct tcgcggttct 192481
ggcctcgttg atcaactcgg ccaaattgag cgggctggat ccgtacgcct ggcttgccga

tgttctcgaa cggatcgtat cgggcagcac gacgatcaac cagctcgaga cgctgctgcc 192601
ttggaattgg aaagccgatc aggtcggtca agccgcatga cccggccagc cgtttcctat 192661
gacgaactcg atgagtacct tcgtggcgat ggacacaacg actatgtcgg agtgagcgcc 192721
atcgatgggc tgatcgcggc cgtcgtggcc ggcccggtga cgatccttcc ggatatctgg 192781
ttgccgcacg tattcggggg atcaatgccg caagccaggc cgggctcgat cgaggagcgg 192841
ctcgtcaata cggtgctcaa ccgtcacgat gaagtggaaa gcctgctgcg cgacgccccc 192901
gggcactact atccgatctt catgaaccac aaaggcaaga ccatcgtcgg tccttgggcg 192961
atcgggttct cccttggact cagtctgggc ggcgaggctt gggcgccgat tgctggcaat 193021
gccaaagcca gtgatctccc ccatcatggc cgtcaatccg cagctggcca aactgctcat 193081
ccggctttct cctcaggagc ggcggaaatt gagagcaacc gctcatcatc acatcacatc 193141
cgcagtcctg cagttgcacg ccatcacaag acaggcccga taacaacgca gccaccggca 193201
caaacgcaac cttaccgcaa gacggcgtgt tcgttgcgct tacagtgcac cagatctgtc 193261
gagcacgaca cgcaggctcg agggggaccc tgcatccccg gcgtttcagg tctcaaactt 193321
ggattacgcc ccgcggaccg atggtcgggc tgccgttggg aacatgtcgt agcttatctc 193381
ggatctccat tatacgagag tacaagcaca tgcgcggagg gcgccgatcg ccaactcctc

Figure 3 (Cont.)

193441
gtgttgcgtg aggactgatc gggtcaaact cacgaccgca gcgcccaagc gcaaacgtcg 193501
gtcgggagta gattgaaata ttgcaaatct ctcactgctg ccgtaagccg tctggaggag 193561
gggcctgtag ctcaatggtt agagccgtcg gctcataacc gattggttgc aggttcgagt 193621
cctgccgggc ccaccaaatt ttttgtgtcg cctcataccg cggcactcga acatctgcgt 193681
cgccccgcga tagacgaccg gggctgcctg gaaagcagca tatgctccgt caacgaaacc 193741
tcccagagat agccacggag cccgaggtct gccgcctggt aagtccaaag ggcaactaaa 193801
atgcatccct gatcggaaac atgtcttcgc cgtagtggtg aagtcgtgtg tgatgccgcc 193861
ggcataacca ccgtaccttc aaaggctcgt catattggtc gtgatgggca tcgactgtat 193921
cgatcccgca gacttcgcac gtttgcttct ccagttcgcc tgcattcact gcgcgctgca 193981
cagcgagatg agcatcatac ttccctggat tggcacggcg ccaattcgct tggcgggtat 194041
cggttttcag cattgctgcg ctgcccttcg ttggcctttg ctccggcctg acgaaccctt 194101
ctatcacagt ttcgcttcgg gcgcgacagc ggactgtgcc tcgttgacct caacggcaaa 194161
ctggctacca tccgagtcgg cccatcaagt tcgccgctcg ctccttccgg aatggtgaat 194221
gcacaaattc atggcttgac ccttgtgggc ggctcgtcag aaacgcgagc actgacctcc

Figure 3 (Cont.)

```
194281
attacgcccc agagagggaa agaaccatta gtgttttcgc acgctcgaaa ttcatggcca

194341
aagccttttg caaggccctg ccgaacaaaa tgtcgagcta acggaagcta cccacttgcc

194401
gaacccgtcc aaaagcagga agtggcggaa gacggttctt agcacagttg gcgtcgagcg

194461
cttcgcgtgc gagcagcaat gcatggccgc agcaccgaag ccgagatccg cagcatcctc

194521
taaagcgatt gccatccccc ggagcgggtc aaacgggtct ttattggcgc ctgctgccct

194581
tgaagcatgg ggcttgaccg atgccgaagc ggagtatttc aaccagctcc gtgacaagac

194641
tcctgctgga ccgaattcgc gtggaacgat cggagacaga gaaaaaggcc gagcgtgtca

194701
tagtggcgcc gacattgtca cgcacacacc ctgccgcccc gtccgcggca acggcgacgt

194761
ccgcttctgc ttaggtagcg gatatgttgc tcagcggttc aacgctgttg ccgtatttgc

194821
gcctataggc cgagatgaaa tcttcgtcgc tacagatgca gcggccgctc gagtctttgg

194881
ctttcgggtc atgtaagtga gatccaaggg gccgcagaag attcacgcga gtgcttgtcg

194941
ttgggctcat gggaaaaccc gcactatgtt tgaccagctc cgcggcgagc atgatcccgg

195001
caagcgctga ctgaaaggcc atcggaacca cggttcgaac gagacgactt ccatcgctaa

195061
gctggaatac cagaccgccg cagatagcct gctgatagaa ggaacggaga ggttggccaa

```

caaacggggc gagcggctca aaaggcacgc ccatcgccgt agccactcga accacgaagt 195181
cgttgggaac gccggcgtta gtctgcaata gcgctttcac ctgctcgtgt gtttccggta 195241
tcccgagttc ctcggcaatc agctgatgct cgtccttgga ttttccagac ggcatgtaca 195301
tgcaacaaag gcatgcctgg ccgtcatcga aaccatgccg cgagatgccg aggtcgtgtt 195361
cctgcgtcca cgcattcgcg atccatcggg gcagagcacc ttggacagcg agacggtcgg 195421
cggctgtgtc aagcgccaca cccactcgat cgaaaatcca gtctccccgg cgcgcgacat 195481
gttctgccca cttcagcgga tgcgcttcga cctctaaagc ggtcgatcga agggcggtgg 195541
ttgcaagaac cgccttggac atgccgatct ccgcttggcc ggccaatacg tagcgctgca 195601
ggtttgagag ttcgaccgct tcgtggtcga cgacatgcag gcgacccgag aggccggatt 195661
gtctcgccag agcccaaagc gcgccatggc ctatcgcgcc gagcccaacg aggtgcgttt 195721
cgccaaggtc gacaggaagg tcaaccgggc gagcatcgcg agctttggtc ttgttgtagc 195781
tgtataacga gaggtcaatg tccgggtcca actcggcgcc ggttaactgg gcggcgaaga 195841
tggttcgaaa gacgttggcg gcgccgaagc aactggcggc gccagctcca taggggagca 195901
aactcgagcc agagcccacc gggtccgtac gcgacagctt tgccgcccaa ccgtccgatc 195961
cgatgaaaaa ggttgtgcac cgcagagatg gccgcgtcgc gcctgcaact aggcagacca

Figure 3 (Cont.)

196021
tggcggactt gccggaacgc cgaatgccga tttttggatt gatcgacttt gccaatcgct 196081
ccagcgcctg ggcttgaaag ctcgacgcac tgtccaaggg gagtattgcc agaaccggat 196141
acagtctggc aagcaacctc accgcaagat ctagcgtcgc ctggccttcg gcgcaggaag 196201
cggcctgatc gtcgaaggcg acggccacga cctgcttttc aagagccgct ttgaagtcgc 196261
ccagatgaaa atcggtcagg acctgagatg ccgccgtcgc ggcgcggtcg atgaaattag 196321
caagggccat cgtcaactcg ttatcgtgat cattcgcgtc aggaccgcgg acgggacctc 196381
attccaattc gccttagcgt caagtcggta ggcggcaaca tgagcaaaat cgaaaggctc 196441
ccgagcgaaa ttcggcacta ccagcgacag acacccaatc gtggtagcga ccgcataggc 196501
gtcatcggtc gtcgagtgat aggcgcggcc cggatgacta tggatctgcg ccagaagcgt 196561
caggccacgt ttgtagagcc agacattgag ccggtgcagt tcttcggcag ggaccatcac 196621
acagacgcca tcacttgttc ggatgtggcg ctgcgccggg atcactgtct ccgctatgac 196681
aaaatgctgg tcttgctgga cgccgaccca gagtgccatc ccttcatggc cctgctgtcc 196741
aaccgaccgc agatgcgcct gtactgtgga cacgcagtct cgggggaggg cgactgtcct 196801
gacatcctct aacgcgctca ttctggaatg gcctgaggtg gtactagcag tcctcccaac

Figure 3 (Cont.)

196861
gcgacctgaa ggtgaatctg cagttgctcc gcagggccgg tcccgtattt gatgatcttg 196921
tccaggatga aggccaaaca gccttcgcca gaaccccgat gaagtagcca tgggtcacct 196981
gagtgcgctg gattatcgtg gtattcccgg actccagcca tgcataggaa tggttggtcc 197041
tcgagactgt tggcttgaat gaaatcggtc aatgataccg cgttctgctg gataagattt 197101
gaaatcattt ccgtcggggt tccgggcagt tgcggacgcc ttaacatatt caggggaagg 197161
tccttccggg caatcggctg acgtgtaaac ggatcgacga agaccacaga cagtggtctg 197221
agatcgtagt tggtgaagtc gatctcgatg gccgcgccga taacgcgcgg ctttaccttt 197281
gggctcgcaa atatgaagaa agcgctcggg aagctctcct cgatcagaaa gcagccttgc 197341
atcctatagg catctgcata tgcgcggaac cggctgatct cccgatcaaa cttcgctcga 197401
gagaccttcg ggtccacagt ttggagttca ggcacctgcg acacccgcct tcaagctgag 197461
gaacagggtt ccagtgttgg cgaatccgaa atcaccgatt ttcttgtcgg cgtcgagcag 197521
cgtgccggcc tcgtccttga actcccagtt ctcggcaggt tgggccacgt tttgcgtgtt 197581
ctcaagggct ttggtgcgaa cgacgtgtag cggctggttg ggattggctt cgacctgcgt 197641
aggctggccg ttcaccacga cgatgatttc gatcttcccg gggccgcctc cgtgattatc

gcccttaccc gcttccttcg acattgtcat actccagtgg cttgccaacc ggccccaagg 197761
cactactgcc gacctgccgg tgagcgggct ggcggtcttt gatcgtccac tcggcgccac 197821
gaaccgcgag cacgtgaaag acaggggata agctaccgaa tcggtgctag ggcttttta 197881
cgcggtactt gagaggcaag taaacctctg gaaaactgct gatcacaact ataatcgatt 197941
agagcagcta aagtattggc gaaatcttcc atgagatatt gcggtatgat agcgctggat 198001
atataatgct atctttgata tcttcattga agggaagcca tcatggcaaa tgtgaccgtt 198061
aggaacctac ccgacgaggt gcaccgagcg ctacgcgtac gagcagcaat gcatggccgc 198121
agcaccgaag ccgagatccg cgacatccta gaaacgactg tccggccccc ggagcgggtc 198181
aaactcggct ctttattggc gtctattgcc catgaagctg gagggctgac ggatgccgaa 198241
gcggagcatt tcaaccagct ccgtgacaag actcctgctg aaccgatgag cttcgaatga 198301
tcgtgctcga caccaacgtc atatccgaat tgtggaaggc cgagccggac cgcgctgtgt 198361
tggcctggat cgatgcgcag atgattgaaa cactgtattt gtccgcgatt acggtggccg 198421
aactgcgttt cggcttggcg gccatgccgg caggcaagcg acgcacgatc tttcagaatc 198481
gcttggaagg agaggtcttg ccggccctcg cagggcgcgt tcttcccttc gacttggacg 198541
cgtcgcgaag ttatgcggac ctgatggcgc aagcgaaaac gtcaggcaag gtcatcggca

Figure 3 (Cont.)

198601
aggcggatgg ctatatcgcc gcaacggcgg ttgcgcatgg ctttatggtt gctacgcgcg 198661
ataccagtcc gttcgaggca gctggactag acatcatcaa cccctgggag ccggcatgat 198721
cccgccgatc tcatttctct atgcggtatg ttaaaccata atgtggcggc caggttgaac 198781
tgtccgccgt tgggcaaagt taaaatgtca ctttggatac gtcttcagcc atttagaaat 198841
acgacactcg gcatgtccac ttgcgctgag gcaagccccc gaccgggccg gctgggccgg 198901
gttgcaaggg aagggagggg gcgggtgaag ggcacccctt cggctttagc tttctcggtt 198961
tcaattattg cgttcctggt agatgttgca ggcagctgaa tgtgcagggc caggatctcg 199021
cgatgcttcc ggaaatcagg ctgatgggtg acgtcgatgt agccgcgctg tcgccactgt 199081
ttcgtggcat ggtcatgact gtttcctacg ccgagaccca aggagggatc ggtctgaccg 199141
cgtcgggggc gatgaaccgc aagttcgtcc actgggccgc tgttcacttc gattggcccg 199201
gccacacgtc ggacgacttg tacagcgtca gcaaggttct gaacgaagcc gatatgccgc 199261
cgcttttggt cgtccgcgac atgctcaagc acttgcggct tcttcggcgg cgaaaggacg 199321
tactggtacc aacccaacgc ggccgagact ttctggtgag accgcaggcc ttcttcgatc 199381
tgatcgcgac ggattatctt tatgcttata tccactacgg gcagacgcgg gaggctgtcc

Figure 3 (Cont.)

199441
gcaatcggat gcgttggtgg cacgtctttc tcaatcttat caacatgaaa gcagaaacgg 199501
gctgttcgtt ggacgacctg gcgaacgagc tatacccgag cgaatcgtac ccggagccag 199561
cagaaatgac tgtcgaaacc tgggcggaaa ggtcggcgct ccgctacgat tcattcgccc 199621
gctgtgctgg ttgggattgc tgcacgaaga gcgcgagggg ctgaccattt ggcagggcgg 199681
aacctaccac aagacaccct tgtgggctgc ctgtttaaag ctggaatcag acaggcaatc 199741
cgagtttatc ctccattgaa ctgtgccggg tagggttgcc cttgctccac cgcaccttgc 199801
tgggaaagcg cctgtcgacg ccgagcaatg acggccggat cgttcataaa atccgtccgc 199861
ttgcccggct tgcggcgccg cggtttgtag ccaatcttct cgctgttggt cttcacggtg 199921
tcaatcggcg tccaaagacg aattcggcag tgcgacaagt gcccgtggaa agtatcaacc 199981
gaccctcacg atattccgca tggctacact gaaacgctgc atcacgcact tgcgaggacg 200041
attgccgagc cgggatccct gcacgacgca ggacatgtga tggcttgtca tgagcaccca 200101
ccgggagacg aggccgactg cgtaggctgg ctcatgaacc aacttggtcc aggcaacaac 200161
atcccactgc gcctcaaggt tcggtcctgc gagaacatag atgcggtcac attggacggt 200221
ccgcagcatg aacggtttgt ggatacgttg cctaaaaccc gcaaggaacc agccgattag

gtggtctgcg gccgcgacgt gagcgcttcg agatgacgag agatcgtaac cgtaccgcgc 200341
cgccgctttg ccgccaacgt gtatgcgatc gcctgatcca aatttccgat tggctaggtc 200401
agttgctgac aacatggtgg ttcatcgcgg tcgccacttc cattttcgag ctaagcacat 200461
aatctgggcg cgacgccgga gaccgccact atgacgacac caccgaccga acccacctac 200521
tgcctggcgt tggtaaagcc cggctcgcgg ctcgctcgcg aatagaagct gctgaagccg 200581
agctacggaa tctacgagta cgaccgagcc ttcgggacga gggagctgcg ttggggtgat 200641
gggtcctggc aggaactcac cgatgaagac catgccgatc tgattttgct tccgcggctc 200701
ggcaagaaag acattgaagc gctttttgac tactgagagt tcatgaagca gcgcggatct 200761
atcttagcgt cagctcgcaa gaactcggtg cgccaaacca acgctccgcg cctttcgccc 200821
caggaggtga gctggttttt caaagaccgg atgccttggt aagattgacg cggaagcggt 200881
cgcgccggcg ctgatagttg cgggtcattt ctgctgtggc ttttgcttcc cgatttcaat 200941
tgaagcggta agctgaaatc tcggccttga ttttgacctt acgcttttac gcgccgagga 201001
aggggaggct ttcgaagccc ggatgcttgg tgcgatcgat ccgaaattgg cgcgccggcg 201061
atgggatttg gccgtactgg catgcggagc tctggaccta acgctcgtcg acggtcgctt 201121
gtcccaaatt gctgatgctg ccgttgatgt ttgatctcgc aatcgccgtg gcaaaagtgg

Figure 3 (Cont.)

201181
tttcactgaa acccttaggg gaaaatcgtc cggtgcctat cgtctaaacc cagccggcat 201241
acgacaattt ccggtttgaa gtggcaaagc aaaacctaca tcgggtggca gtgccgcttt 201301
gacgttcgaa agcattgcga tgcgagccta tcggccggcg cagaagtgcc gatgacgccg 201361
gcgcgccaga ggcggcggat ggcaagacga aggcggtcgg tccgacgggt tcgatgaagc 201421
cagcgcgaac gtcgtttgtc gcctcaactc tcattgcggt tggtgacgga cagcctgacg 201481
ccgtgtgcct gcgaggggaa ggggagaggc gccttaggct tttgccgcga caagggcggc 201541
cagcggcgca atagcctggc catcgaggcc gaggcgatca ccgagatagt gccagaacga 201601
caggccgagc tttttgcagg tcttcatcag cccaagcatg gtgtcgcgcg ccacgcgccc 201661
atcccggctc atcgtgccgc cggagatctt tcgcttggtg acgaagctgc gcagatcgtt 201721
ctccgacgca ttggtgtgca gcgggatatc cggccgttcc aacaccttga gcagttcgtc 201781
cttccggcga gaaagacgag ccagaagctt gtcgaggtct tcatagccgg tgcgcagcga 201841
gaagatgcgc gcgaagcgtt tgcggaatgc ggcggcaagg ccgggcgggg gctttcgttt 201901
gacgctcttc agcgcccggt agaaccgcca cacaagatcc cgcaccgcct cgacctgtcg 201961
cacctgccgc ggcgttgccg gcatcaattt ttgcagcagc cgctccgcat agacccaaca

Figure 3 (Cont.)

```
202021
cagagcatgg ttgccgactc ggaactggcc ggcatcgtca gagacgatca ccgtgtcgcc

202081
gagaagaccg tgatggcgga tggatcccca gatgccggct tctgcgagca cgcggaccgc

202141
ctgcctgtcg aaaatgtcga tgcccttgcc agccagatat tcgaggaacg gcacctggtc

202201
gcaaaagcgt cgtggttcgt ggctgcggat tttggccaca agcgccggat cggcacgacg

202261
gccgtccaga tagtcgaagg cggcgtcgtt gaggacatag tcttgatagc tgcctctgag

202321
cagcgacagg aagttcagcc gggattttga tgcggttgtg cggaaagcgg taaaatgctc

202381
agccccgatc tgggtggtgt ggaagctatc gcgcgcatgc cgggcaccgg tatcgtcgac

202441
ggtgatgtag ggggccgaga caaggccggc atgcagcaca gccgcatcct cggcagcaaa

202501
gccgtccagt ccctgggtca aaagtcgcac gacctggcgc ttggagacgc tgacgccgac

202561
atcgttcagt cagccgcgcc atcgtcacct gtccttgcgc gtgcagcatc aggcagagcc

202621
gcctgaggtt tggaccgtag ccgccgacga ccccttgcgg cagcggcgcg agcactgtct

202681
tgccgtccgg cgtgatccaa tattcgcgcc ggtagtgaac gagctcagct gtgacaatca

202741
ggtcccgcac atggcagctc ttgggcggaa cacgggcgtg caggatttcc tgccggctca

202801
cccgctttag atcgagcttc gggccgcgcg gtttcttcct ggtcgcccgc ggcgcgtcgc
```

Figure 3 (Cont.)

202861
gtttgtcatc cgtcgccttg tccatgcccg acgggcgaaa cggcggccgt ggcggcaggt 202921
tcttcagccg tgcgatctcg tcgcgcaaaa gctggttctc gaccttcagg cgggtgtttt 202981
ccagccgaag cgcctcattg tcttcacgca gggcggcgtt ctcggcgtga agggtcgtga 203041
cctccgctga aagctccttg acctcatcga ccagacccgt cacaagcacg cgcaacgcct 203101
tcagcgaaag cgtgtcggca tgttcgggcg aggcaagtcg cttcttggcc atgatcgaaa 203161
ggaagcatga tttgccccaa gcgcggaatc ccacccgcgg ctccgaccct ctacatcgcc 203221
cgcttatgca cagttctcgc agcgcgtcga tgaaaagtcc gccacccaat ctgccccggt 203281
tacccgcgac cggtccaaaa tctccgcctg gcggaaaaat aatatccgga tcgagagacc 203341
caactactcg tcgttgcaca cggggtgagc atgaccgcga aatcggactg aagatgaccg 203401
ggccggacct ggcgcggcag atggtggggc gctagctcgc ggggcggcgc acttcgtcaa 203461
agctgccgga agtgatcgag tcatggcaaa accgatccct tcggccggca ttggccacca 203521
agacaccaga ggtcacgccg caggcggcgc cgcggattgt cggcgaattg ggcttgagag 203581
aagggggagg tttcgtggaa aggtgcgctt tagctgttga taggttcacg tgcgccggtg 203641
aatatcgatt agaagttgaa aaggctcttg agcgtttcag atgtcgtatg tattcgagat

atttataagc gatcggcgat aaagcggaat gagtctctta atggcacatc ggaagtcaaa 203761
atcatctcag agaaaacttc ggaaccggtc gtcatctcta accccgcaaa agcgccgtat 203821
tcgggcctcc aagggctcac acgacactat cctgagtatt cgaaatgaaa cttcctcatt 203881
ggaagcactt agtcgtacta ttcagtggac cctcgcgagg tacaagtatc atcgttactt 203941
ggtatcacta tccccgcgga ccccatcgca gctcccggac tatgtcctag ccgcgaatga 204001
tagtctagaa aatgcgatga aatggcagat tgcttcaatc tccgccgttg gcggcaagat 204061
cgcctctcac aataaaaata cttataccag cattgaccag atcactgatt actccgcctc 204121
cttggaaagg gcaaatgcag agattcgaac gtgcatgtgg agcttttcgt cagcctctca 204181
agctctattt tcgctcgcga gaacgaaagg cctcgacgct caacgtcgat ggatgcaagg 204241
tagcctttac gttgcaaatc cttcaatatc aaacataatt ctctatagca aaggaatagc 204301
gtcagaagga gatcggcatc catcggacgt acttgaggta ttgaatagat ttatattctc 204361
aaaatttgcc gacgaagagc taaatttgct attgtactac ctgacattta accctcttct 204421
gaatgtcgag gtggcatcaa agctttctcc tctccttctg tattttcctg tagtcgatca 204481
gtatgagttt ctagctaatt tattcacgtc agatcagagt ctatccaaac cagatgttct 204541
gccttttggg cgagattttg tcgagattct gtcatctact ggagattggc gcgcaagccc

Figure 3 (Cont.)

204601
aaaggcagcg ctcgcagaaa gggtcgaacc aagtcgtttc actattcctt tgctgaacag 204661
atggtgcggc taccttctcg atagtattgg gatactggat ggagtttctt cggcgcccga 204721
tcgcgaattt gacatcgcct tagcaaacga gtttttccat cagccacaat ctccccgcgc 204781
gtatctggcg agctccattt ttgcgatgaa atccgctcag acactcgccg acgtcaagtc 204841
ggcattatat aaacgggaga tagccaacgt acacttcgag aaagtagagc aacaaattgc 204901
tccgcccgat cagcgcttca ttgactattc ttttgccgca gttgccgctg aagtcggaat 204961
ttcggagtcg gtatacgaaa atcgggaact attcagaatt gcttgcattt gcgggattag 205021
cgagggacgc acgctcgata cgctcattct tctttgcgaa tatacgaatg ccgatccatt 205081
tggatcaagt tactttcctg cagacctatt ctccgcgagc gtaactgaag acgaggtggc 205141
caggattggg catgatccgc gggttgctat cgggctttcg cgcgtggccg ctagcctcgg 205201
cgatgaaggc caaaatctgg tctacatcgc agttgaacaa catctcaacg ttagaggaat 205261
gagcaagccg agtgaaattg tggctgacag tgctgtcgac gtcgctttcc ttcgtgaagc 205321
ttgtacctcg agctccttaa ggcaatcgct agagtttttg tcaaaggccg agatggagga 205381
cgaacggatc caggttctat tcaatttggc tcaggtggat cctgcaaatg aagacgatta

Figure 3 (Cont.)

205441
catcgaagaa gttcacacaa tcattgggca gcaaacgatt gaggagcttt tgcaacgatt 205501
ccatgtaggt aaagtgcagt gcgatgagca agcgctttcc acatgggcgc tcatagaatt 205561
gagtccgaag ttcaaccgtc tgaaagattt tatcgatgcc ggattgccgc ccgtagagaa 205621
ggacgctgac attcaattta tcgctcattt gacgtcggga aaatcggaaa catttacttt 205681
taaagttccc aataatgagt cgctcgacat tgcccgcacg atcttggcgg agttgaattc 205741
gaaatatgcg ttagacccgc gctatggcgt agactcgtac ttgagcctgg ggatgcggca 205801
tggcgcggtc gaagctcatc ttcagagccc gctcagcgcc gagaatattt tgactgcgaa 205861
ggagcctctc ggatacccgg acgattgttt ctggacgagg tatttcatcg acaatggttt 205921
tgagtgctac ggcgagaaaa ttgggccggt gctagcaaca ttttcggaga agtttgacaa 205981
taagctggag gctatcaaga acgatctttt gcaggttcgt cggccggaca aaccagaagg 206041
gctaatagta gcagattggt cagaggcttc ggttttgtcg gcttgcgcaa gatttgccga 206101
ggtacctgac tttgaagcct tcattgctga gttcaccttg atcttttggg cgaacgtgga 206161
aggtaatctg gctgccgccc gtgaattcat agaaaacgtg ctttcgaacg agctaaacga 206221
gttgctagac gaactggagg caaacgttcg tcaagcaact gggcagcagc gactggcgcc

tttctcagat gcactcatgc gcgcacgcca ggagctcggc aacgctgtca acgacgtatc 206341
gacatggcac aatgtggctc gttctactga cgttgaacca cttggtctgg ttgagattat 206401
tagcgctgcc cagaagattg tttgccgcct gtatcccgat ttcgagccaa gagtaacgtt 206461
ttcgggagac accggcataa ccgtaactta ctcgctccat atacttattg aagtgtttaa 206521
ggccttgttc acgaacgtct acgcccattc agaagtggag aacccagccg tggacgtcca 206581
catggcaatg acggttgaag acgcactgga tgttgaattc gtcagcgact gcaatgatat 206641
gggcaaagct gagcgggccg cccttgatgc caatgaaaaa attaggactg gggaatacga 206701
gaaaaagctg ccgaaagaag gaggttcggg tttagcgaaa gtggctcgct ctactctgcg 206761
agacggaaaa ccaaacaccg tgatttcagt tgatcattcc acgtgcaaat ttcatgtaaa 206821
gatggccttc aaaataatac agatatgagg ctcaccccga tgaaaacctt aatcgtcgaa 206881
gataacccta aaaagagagc ctctttggtt gaatactatt cgtccgagtt tccttcggat 206941
gacctggagg tgacatctgc tttaatatca ggactgcggg tcgcgcgaga tactaagccg 207001
gagttcatta ttctggacat gactcttccc aattactcgc ccgatgaaaa caaaggctcg 207061
cgtatcgagc tgatgccttt cgctggccgc gagtttgtga tgcgagtaaa tcgaatgtct 207121
attaagacga aggtgataat tgtttcaatg tttgagactt tcggcgtggc ccctcgcttg

Figure 3 (Cont.)

207181
ataacgctca acagtttgga cgctgagtta agggacagat accccaatgt ctttgttgag 207241
gcggttcatt attcccaggc ccaagcagat tggaaaacag caattaaaaa tgcacggctt 207301
agcttggata gataaatgcg aattctgatc gttgatgacg aaaataccaa ggttgttgaa 207361
atctgtggcg ttttacgaga cgcccaaatt acagaggagt cgattactgt cgctacgaca 207421
gcagctagtg cccttaaaga gctcaaggag agctacttcg acttgctaat cattgatatg 207481
tacttaccta accgaattgg tgaggcccca agcctctcgg gcggggttga tttattgaag 207541
cggatcaacc gtgggaacga tgtgcagtta ccggaacata tccttggttt aacttctaat 207601
ctcgaagctt tggcggcttc tgaggaggat ttctccgcga gatcgtggtt tgtcgaagaa 207661
gtagggccat caaagaccac gtggaagctc cggctgatgg agaaattgca gtatcttaaa 207721
gcgcgtgagg aatatcaagg caaccagtcg aagagcgaga ttatctctac tcgacccgaa 207781
tgcgaggttc tgtttgtttg cgcgctactc gatcccgaat tgacagcgtt gcatgcagtt 207841
tctggatgtg actgggaagt cgtaacattt cccggtgacc caggaatcta ttggtcagct 207901
agcttgaaat tcggtgcaaa tacggtgtcg gcgatctgcg tttgcttgcc gcaaatgggg 207961
ctcgttgcag cgggtgtcac ggccgcgaag gcaataacgc tattcaagcc caaattggtg

Figure 3 (Cont.)

208021
gttatgaccg gcatctgcgc tggtcgaaaa ggcgattgtg acctcgggga tatcatcggt 208081
gcgaatctga catgggacta tggcagcgga aagtttactg aagttgccgg tgcggttgtg 208141
ttcgagcccg cgccgtttca agccgccgct accgcacgag tcgggggtgt gttggcggaa 208201
ctttccaacg ataacgagct attgcagaag ctgtataagg aaagtccggg ctatagacct 208261
gctaaagttc cgaagtttca tgtggcgccg ctcgcgtcag gcgcagccgt ccaaaatcat 208321
aaggagtttt tctctggcgt agttacgcaa cagcgcaaga tgttgggggt cgacatggaa 208381
gcgtttgcca tagcctgggc gtgtcacgag gcattagagc ctcaaccaag ttggctagta 208441
ataaaatcgg tcgtggattt tgctgatgga acaaaagata gccaaataca atcgtttggt 208501
tcgtatatca gtgcatcact ggcaatttac gcagtcgata gactgataaa tcgttgatgg 208561
ggtgtcagtt gccggtcagt cgtccggatt cggtggcttc ttccggttca aggcggtcgc 208621
cggtcaggag atcgtgccac cctaggcggg tgccccgctc atttcgatgg gctggctttc 208681
ctgttcgcgc gaggcattct cgtgcggatg atacataatc tggaaacagg gctcaaagct 208741
aggcgatcgt atccgctagc cgctgcgcaa caccttgtag ctaccggccg gaggaagaag 208801
cgttgcgcag aggaacatcg agagcgagca tttgggggat agtccgcgtc atcttaaggg

aactcataaa gccggatcat tctaacttgg aaggcaaggt gaagtccgtc ggactgaggt 208921
ctagtcgttg ttcgaagttt tcgaactcgg cggggctaag aacaatacca ttgcccccca 208981
ccaggccgcc cgtctgcgga agtccctgcg cttgaacatc tgtaaagctc gggatttggc 209041
cgtcgggcca ggcgtcgatg ctatcgagtt tgatctgttt tggttccaga atgacgccga 209101
gcaatttcgg gtcaagccgg tagtctgacg tggcaaacat ctcgcgggca tttgtggcat 209161
ttgtctcaat gctctcgagc gagccactca caacgccggt aggcagtaaa tccaatgttt 209221
cgccgtccga agtcttgagg ttgcgtgcga tcgcgttgaa cttcccgacc gcgacagcca 209281
atgccttagg atcttcgaga tttatcgcct gcttctctac tgttgttgtg accatcttcg 209341
gcaatgacga gcaagttctg ccgccgaacg gcgtcggctt gcactggagc tcgttgacga 209401
ccttagtctc caacgtccag tcgggcccat aggtggcgac agcccaatac atggcctttg 209461
ccttccaccc cggcactccg tttgcgcgca tgccgtagta gaaatttcga tgtgtgtcgt 209521
gggccgtgcg ggatttggtc tcgcagaagt agtcgtggat caccgatgcc ttgagataag 209581
cgccctcaaa gggacccccct ataatcgacc aaaaagtctg cgggatcgac gctccatcaa 209641
ctctcgtccc cgtgggcact ggccacttta ggccattagg gtcatcgaag ctgaagtcgc 209701
tcgacagctc gaacagtgga cgcggatcag catcgataaa ctgtcccgcg ggtccgctcg

Figure 3 (Cont.)

209761
agaaggtgcc gaaaaattcg gctgcctggg cctcggcgac gccgaagccc agaataactg 209821
tggcccccaa caatcgctta gaaattttcg cgatttttcg gatctctgcc ggccaagcgc 209881
ttcccatgag aattaccctc ctgtcaggcc gatgtttcac aagtttggga gtagttgttg 209941
caggtcgctt ctgttgagta tctggatatt gcgcagttgc agctcattga ttgcatcgtt 210001
cgcgttcttg atcgcgcttt gcgccttgcc cagacgtcgc cttggtctgc gttcgtcgcg 210061
aggctcttcc tcctcgtcct gcacggcgac gccaatggtg acggtgtgta tgtcttgtct 210121
ccaatgggat gactctgcgt caacagccac gatcttcaaa tggttagcgg gatccagttc 210181
ggcactggga gtggccgaga agctgttttt agtcgtgaac tgaatctcat cggcaagttt 210241
gttgaccttt ggctgtccac tatcagtgct gccaagaata tggtcttcat tcaggcgcca 210301
aaacgtatcg attatttctt gaagcccgat gtatccggtt atgggatagg cgtaattttt 210361
ttcgcgcttg aactttccgt tctcggaata gggctcgcac ctcgggggat ccgtgaatag 210421
cttgtagaaa ttatcctcga ctctaaaacg ccgctgattt cggcgcgttc gctcgtgggc 210481
accggaaaca cccaagttga atattccact gctccaggta tcgttcagag tagcgccaag 210541
actgtttctg ctgtgctgcg acatatcgaa ctcgaagtca tagacaatcg cagcatttgc

Figure 3 (Cont.)

210601
gtagagatcg atcttctttc gtgttgcatt tggaagtcgg ctgcgatcga agttcgcgat 210661
tgtgtttggg tcttcctcta tctgggtgac aatttccgga gatacgttgc tgcgactgtt 210721
ttttaagtac tcaagcagtt cggacaggac ggcatctcgc gcttcgcacc gaattctggt 210781
gacgatcgca taagtattca atcgggtgac atcttccgga agtggcctga tagcgcagtt 210841
cggcaacaaa gccgctgctg ctgtcaacgc gatcgcatgc ctcatcagtg ccccccgaca 210901
aagacccgct gaattggtca acgctgagaa tcggcggcgc tagcttttgc cgcataattc 210961
cctcattagt cccctctaaa ttgtccgaaa tgccggatga tggcaacttt aaagtttagt 211021
gatcaaccta tgattatgtt tcgcgtgccg gtcgccggct ctgttgacaa tgagttagtc 211081
caggcttgca tgtcgcgttt tattggtgtc tgatgggtga tcttaccagt cctgcgggta 211141
tcttgccctt ccctgtaagc atggggttgt gtcagtgggc ggaaggacct gggcgaccat 211201
cgccacgctt ctgcagacgt caaaaatgaa caacgtcgat ccgctcgctt agctcacgca 211261
aaggccccga tcttttcagt ggcgaggagc gatctagttc agcgccaact ctagcaaagc 211321
acgcctgggt tcgtatcggc tatgtgtcgt gaggtctcga ggcgtgggat gtgcagcggg 211381
tggccgtcgc agttggtgac gtcaaggaac ttaacggata gattgtacct ggttccacaa

aacacgggat cgcgctgccg cggcttgagg cccagtggcc aggcacgagt tcaaagtgaa 211501
ggaaccaacg attcccaccc agaatttccg acagctcgcg cgatgagttt tctgtaagcg 211561
tccggtgagg cagcttcgcg ctgacggctc gcctttactt taccgaaacg gctcgtgcga 211621
caacttgtag tttgatcgcg tcaaaacagc caacaccggc gaatgcccag aacaacgaaa 211681
cggctactgg ataaactccg cgaggtcgaa gcgctccgag gtgacggtcg ctcaccacct 211741
cgggggatgc tgtcaagatt cggaaagggt atggtggcct ttctgcggga atatgtccgt 211801
attctcgcgt atcatctctc cgtggggccg tttccccgcc tcagtaaaat cattgctgca 211861
gtcggtttag cggtgtctgg tcccggagtc ctctacaagg ttatcgaggc gatcattgcc 211921
ggcgaagtcc gcaatcgcgg ggcggtcatt gcaaccgcaa aagaagaacc tttcgaattc 211981
tacaccatga cgctcattgt tggctcgggg gctgccttcg ttaccgcctt gggtgttgcc 212041
gccttcctgg tcctgatatt gaagggccgc ccatcgcgca gcgagtgatc tattgccggc 212101
gcgaccgatg ctatcgatct tgatgccgca tgttccacgg gagcagttct ccgatcctgt 212161
tgatcggatg gtcggcgctg cgggtgagga cgtcgcgaag ataggcttcg ggatcgagac 212221
cgttgagctt tgcggattgg atgagcgaca ggatcgccgc ggcacgctcg ccgcccttat 212281
ccgatccggc gaacaaccaa ttctttctgt tatgcatatc tatacataac agaaagtcat

Figure 3 (Cont.)

212341
ggctctttgc cggctctgat cgaggtgccg atcgcgccgc cttcatggcg acactgagct 212401
caacaacgtc gatccgcagg cctggctcgc cgacgtcctc gcccgcgtcg ccgacacgcc 212461
gatcactacg ctggagcaat tgctcccgtg gaattggcag ccgccgaagt tcctgcgaga 212521
tcaagctgcc taacctgcgg ccttggccgg atggttacgt ctcagcggct gcaatcgccg 212581
caggatggcg ccctgacgag gtcgcctcaa cgttggttga ggttgccgac cacgacatgt 212641
tcgcgctgat cgaaaaccgc gatctagcag ccgatcttcc catcctccgg ttccgaccgc 212701
ggtagcgtct gtcgccaagt gccggcaggc ggcccgagcc gtcactgatt tatggtggcg 212761
gcagcaacag agttggctgg ccttgatcgt caaagaatga aaccgcgttc gaggctcgtt 212821
gctctcgcca gtatcgttcg gattgtcgcg gtgctccaac ggtcgcgccg actgtctgag 212881
ggctggcaat ccgttgcggc ccggactcaa tctgcggctt tgaacgcgcg gtatcgcgaa 212941
cttcctgcgg aatcggaata acgcgctgag acaggtgact aaggaaagtg gtctcgcgta 213001
tcggaagccc tcggctattc tctcgccttg tcagtctgcg tacctcaaca ctcggagcgt 213061
cgtcgccgga gagttggagg ggttgcctgc gcaagaactc atccataacc agcctggcac 213121
tggcactcac cggcgctcgg ggcagctgga ccttcgtgtg accataccgg ccgctgacac

Figure 3 (Cont.)

213181
tggcaggccg cgcgaaaacc aaacgctcgt tttgcgatcc gtcgggccgg acgccgaaac 213241
cgggattgtc ttccactccc acgacggtaa gccacgtcgg ttcggcaggg cttaggccct 213301
tgaacccgaa atagggcccg acggcgctgc cagcgcgaac atacgcttga agggcaagat 213361
aactccggtg aaacttcttt ttctcgcgct cgccacgatg tacagaagac atggcttgat 213421
gaagcagcga tgcccctatc gaaaaaacgg gaagcccgcg gctgagtgca acgtctatgc 213481
ttttccggat ttcggcttct gccaccccgt ccgtcattgt gccgagtgcg gcgtcgagga 213541
tcgcaccgtc ggcgatctga gggaaccagt tcatgaggtt ccgcacccaa cctcggcgcg 213601
cggccagctt tttgtttcgc aggaggaaat agcccgccgc aacggcagat ataggatctc 213661
cgactttgtc ctggaggaac cgatccgcga tctgaagggt ctcggcaagt tgattggcct 213721
ctgcaatcga tccatccgac aggtaggtga ggatgatttc gttgtccgga atgtcgcgcg 213781
ctattgctat gtcgatggtg tcgctgtcgt tgccagcgct tcgggtcaat gccacgcgga 213841
ccctctgccc aggaggcagg gccaccaacc gccatccaac gtgttcgccg ccgacctgaa 213901
gcagatgggg gttgttgggg acggggatca tgatttgctg gacgccggtc ctgtcgctca 213961
accgttcctc caccggtagc gggctacttt gccatcgatc gtccaccagc gaccacagcg

tcatccaaac tttgccgatc gggggagcct tggcagggtc gtcgccagac atctcgacca 214081
gatggtcgag tgactggaat ggcgtgaccc actccagcca atccgttgga gccgtcttgc 214141
cgatatcgaa agtcgcatct cctttatcaa cttgccgatt ggcgatggtc tgcatcgagc 214201
gaccgtcggg gagcatagct acaacgtgga ggcgatcggt ttgatcgcga cggcgctcgt 214261
caatcgttac tttcgcggat cgctctggcg aagcaatgcc agaggccagg aggtcaccct 214321
tggacgagaa cacgttgaag ggaagcgtta gtaggttagt atccttctgc gacccggaaa 214381
caataaccgt taaatccatc cgacaatccc ctcagtcgac tttgatgagg cgacgaactg 214441
cagcgttcgt cagtagtttt cgattataaa tcttctccgg aaaggacgtg ggatcggtgg 214501
aattcgttcc ataagtccat tctccgtgct ccctgacgaa ccggaccggg ccggttgcga 214561
gaggctttgt atccctgacg agagcggtgt cttccatgaa ggcttgcgcg atggggcgga 214621
aaccttgcgg tagcacgtcc aattcaagca tcaccgacgg gcgttttgac aagacgtgga 214681
gaggcacggt ccagttgccg tcaccctcgg tttttccgat tttttggcga tctgccatgc 214741
cctcgggttg gaggaactcg agaaattccg atattgcggc acgtaatctt gccacgtcga 214801
cggaatagcc gttgccactc ggatgctcga ccccgcaatg tcctcgaagc gctgacaaaa 214861
gggcctgtgt aaagtgggca actcctccgt cgggcgcgta ggccaagcgg ttcgctgttg

Figure 3 (Cont.)

214921
tcgcccggac gattgcccag tcggtcgttg tcagcgcgcc tctccgcgac ccgccgataa 214981
gcgccttcgg atcctcaagc tggtttatga tctcctcgct caactccatg caagcgtcga 215041
tgaaatagaa gaggctcgcc ttggactttc ggagcgtggc ctgcaccgtc atcgtcaact 215101
gaaagacggc attccaaatg tcggcttcat cttcaccgaa gtcatctgcg accagatatt 215161
gtgtctcgcc gtcgctaatc ccatggccgc agaaataaaa gaccccccgg ctctggggat 215221
tgagtttaag gcgttcgagc caggcgacat aagcggtctt gaggtttgcg attgacgggc 215281
gcgtggtctt aaccttggtg ccgaacggtg tgtcgtagga accatttggc gatgcgagca 215341
tcacgagtga gccgagaggg gcatccgcgt tagagaacgc ttcgctcggg tctttcgcct 215401
gaccggctgg catcgcatcg gatccggtca gaaaccagtc agcgacggcg accacggaga 215461
tcggcggcga cgtgagagac ggcaggcttc catatcccgc agccgcaagg ctcggatact 215521
cgccgcaacc gatcaagagg acatgcgtcg cggcgacggt cggatcggct ttcactgccg 215581
tggattcgaa aacgatgctc atcgatatgt ctattccgac cgccatgcgc cccgaaaccg 215641
ccatagcccg tgtcgtactg gaaatccttg acgctcttgt aaataccctc ggcactgaac 215701
gagaaaacgt cattggtgtc gaagacgttc agccactttc cgacattcgg attggcggca

Figure 3 (Cont.)

215761
atgcgatcat tcttcggatc agtcggcatc ccgggaggta gcggtcgact atagagcgcc 215821
atctcatcga acaaaccgac ctgtgaaccg attgttgcca ggtagtcgac tttcagatcc 215881
ggagcgaaat aggaaagaat atcgtaggtg atgaccccac caaggctatg accgacgatg 215941
ataagcttgt cgtcgccctc ctgccgggcg gcatcagcgt tacggaacgc ctgtagaacc 216001
gccctaacaa tcgggccggg cgccgccgcg gtcccgcgat ttttgaggta gacgaatacg 216061
tcgcccagga atcgcgacgc tttctgatgc gcggatttcc gccccagcgc cagcaaccct 216121
gctgtggttg cgtcggcagg tgccgacccc agcctggcca aggcctcctt ggtcgaggcg 216181
agccatccac tcaaaccgaa cgtttcgagc tttttctcgt ctgccggcag ttccgcaatg 216241
cctctcagca gtgcatcgag aaattcctca ttggatagcg gctcggcttt caacgcccat 216301
gccggcgcgg gatatttctc gatgtaacgc tgtgacgcct gatacgccgc tgcgatcttc 216361
tcaatattct cgggagaatt cgcggtcgcg gctgcagcgt cccaaataag atcgacggca 216421
tccgcaaacg attggtcgcg gctcaccttg ccaagaataa cggactttgc gccaaaggac 216481
tgttgaacct catgaagcca gaggtcgatt tcatttttct gcgctcccag cgccaaggtc 216541
tcatagccgc cacctggcag cgacacctgg ttccagagga acttgacgcc gtctccgccc

caataaggaa agctgatgtg caccttggcc gggtcgagcc cgagcggcgc ggcaagcaac 216661
gtcttcaaga attctttttt gcgcgcgacg tcgttgtcaa agccagcatc ttccttgcga 216721
ttgttgaccc catggacgaa cactattggc aaaacgacct ccccaaccaa ttctgatgcc 216781
ttgaatcagt tgtagccgag gccgcgttcg ccctcaaagg gaaaattttg tggtttttttg 216841
cgtaaggggg cagcttacct gtcaacttgc ggagtcgcca aggcgctcat gaggtcatgg 216901
gaaatcgcgg tgacgacaaa caatgttgga acgcttgcga ctgcgacagc cacatcgatt 216961
gcgccgagca tcttcaatat gtaaccgcgc cttgcattgc actcgtccca ttcgtacacc 217021
atcgagagat ccttcactcg ctgagcgaat tgaagcaaaa acatgtgcca aaagtcgagt 217081
gcacaaatga cactcgccgg gggatcaaac gatctcgagt gagaaatcgt ctaggatttg 217141
tgcgacttca tcgcggaaat ccagcaacgg tccggaagac ttcacgttga gcttggggag 217201
cgcccgatcg aaaagggcgg tattggcttc gccatttagg cgggagtcgt agatgatccc 217261
gtccggtttc tcgtcgtgga gccagagtgc tcgtgaccat tgcttcccga gttcatgcga 217321
agcggcacgg gcagcatcgg tcggtatgcg catgcgcagc attccgtcgg agcgcaggtc 217381
cgcgagcagc agaggttggt tgatttcgac cgacgcgcaa gaaacctcct gaagttctgc 217441
aataccgata ggaaaagagc cttttgaacc gacggcgcgt tcgcgcaaga tcgcttcggc

Figure 3 (Cont.)

217501
aaagcagacc tttatgctgc tgccaaaata aacaacgccg aaccggtcgg gaggagacag 217561
ggttgcgcgc ttcgcaaaaa ctggacattg attccgctaa atcccggaca gcaatttcat 217621
taaagtccgg acagtttgat gcggttggtc ctcggcagcc tggttagcat cagggctgat 217681
tgatttcgcc gttttctgcc ccagtcaaga ggggtgcgct tttttgcttt cgcatgctct 217741
cgccccggag ggtgatgcgg tgagcattgt ggacgatacg gtcgagtatg gcgtcggcga 217801
ccgtgctgtc ggcaataagg tcgtgccagc ttgccacggg aacctgagct gtgatcaggg 217861
tggactttcg ctgataacgc tcctcgacga tttcgaagag gtgaaagcgc tgctgatcgg 217921
agagcgtatg ggttccaaag tcatcgagga tgaggagctg gacgcgggtg agcctgtcga 217981
tgaggcgggg gaaggagccg tcgaggcggg caagcgcgag ctcctcgaac attcggggca 218041
cgcgcacata gagcacggag tgaccgagcc tggccgcttg cctgccgaag gcacaggcca 218101
gccatgactt gccggtgccg gtgtggccgg tgatgatcag gccctcgtgg gcggtgagcc 218161
attgcccctg ggcgagcgcc atggtgttgc gccggtcgag accgcgggcg gcggcgaagt 218221
cgatatcttc gatacaggcc tgggcaaagc gtagcttggc ggaggcgagc cggttacgga 218281
tgcgcttgtc ggcgcgcagg gtgacttcgc ggtcgagcat cagtccgagc cactcatcgc

Figure 3 (Cont.)

218341
ggctgagctc attggtgccg gactgctcgg tcaattcgcg ccaggcggcg gccatgcccg 218401
tcagcccgag ggcctgcatc tggtcgaggg tggggttcgt cagcattctt gcttccttca 218461
ctggtagtag gatcggccac ggatattggt atgcgcaggc gtgggggccg cgtgttcagc 218521
ctgcggtctt tcccggtcga ggccggattt gaggatggag gcgacggagg aataggtgat 218581
ggcattaatg gtgagcgccc gctcacaggc cgcctcgagg cgctgggatc catagcgcgg 218641
cgccagcgac agaatgccca tggccgagcg gtatccctgt tccggatgcg gcctgtcgcg 218701
catcatgcgt tcgaccagga tggcggcatt ggggccgatc tgggtcgcac ggccgatcag 218761
attggccggc gtggtgttgg catagcgctg atgcgccttg ggcatatggt cgttgacggt 218821
gacgtggccg gaacgctggg agcggcgaac atggctggcg acacgctggt ggtcgtggaa 218881
gatctcgacc acccggtggg tgagccgcac ctggagggtg catccgatca gccgatgcgg 218941
caccgagtag aaggtcttgt cgacctcgac atgatagtcc ggatggacct tcgccgactt 219001
ccattccgca tattcgaacg gtatcgccgg caagggcttc aaggctggcc gctcgatctc 219061
ctcgaacagc tcgcggcggc ttttgccgac atggcgcatc gtccggttgt tcaggtcctc 219121
gagcaattcg gcaatcgccg tgttgagggc ggcaagcgag aagaaggtac ggttcctgag

ccgggccaga atccagcgtt ccacgatcaa taccgcgcct tcgacccggc ctttgtcgcg 219241
cggtttcctg ctgcgggtcg gcaggatcgt ggtgtcgtaa tgctccgcca tggcggcgaa 219301
cgtcgcagtc aatgtcggct cgaaccaaag ggccttggcc acccccgatt tgaggttgtc 219361
gcacacgatt gccttggtga ccccaccata gaaggtcaga gcacgcacct gaccgtcgat 219421
ccaatccggc aactgctggc taaagctggc atgggcgaag gtcaggttgg aggcgcccag 219481
caccgcgaca aagatttggg ccggatggat gacaccggtt gccggatcga tcaccggcac 219541
cgtcggcccg gcatagtcgg tctgcatcac ggcgcccgcc gcgtgccgat tgcggaacgc 219601
tacactggtg cgctgccgaa aggcggcaac ctgctcgcag aaccaggtga agccgtaacc 219661
atcaggatgg ctggcgcggt attcctgcca tagaagcgtc agcgtcacgc ctttgcgctt 219721
cagctcccga accaccagcg cccagtccgg ctcgctgaga tcgcgcggcg gtcgaccggc 219781
tcggccgaac agccgccgct ccagctttgc atcctcgtcc gcgccgattg gcaacggcca 219841
cgaaagcccg gcttcccgag atcgcagcaa ataggtcgat accgagctct tgccgatctt 219901
cagccgctcg gcaatctcgc gcaccgaaag accctcttca tgggtcaggc gcagaatagt 219961
ccggatatcc ctcactgtcg ttcgtcttgc ttgcttccgt ctcggcatcg gcccctctca 220021
acgttgtcgt gagaggccta accaacaaga cggcgcagcc gcgaaccaac ccgtcaaacc

Figure 3 (Cont.)

220081
gccgccggaa actgtccggg atttagcgga atcgctgtcc gggaattact gaaaactgtg 220141
tccggagatt accggaaatc ctgtccggac tttgccgaaa cccgcagccg gcaatgatcc 220201
catcaaggaa gggatgagcg ttgaggccac tatctataat gcctataacg ggcgccgtct 220261
ggtcgaccgt attgagggga ggggcctcag caaggaccat gtccatcgct tcggccgtga 220321
caatgccagg cgttggcgga aggtccacag atgctacttc ctcgatcgtc aacaaagtcc 220381
ggaccaacac gccgttcagc cggccgcgga gcattgtgat agaaggaccg acatactggt 220441
cgaaaacctc agccccacgc gcctcgatgt agcgaacgat gtcgtcgagc ttgcgctcgc 220501
gaagacgtcg ctcaccgaga tcccatatct caatatcaat gagataggct tgtccatctt 220561
ggaaatcggc catttcaaca aggccgtctt cgcggaaacg aatcccaatg cggtcacgtg 220621
gctcgaccga cccaatggtt tcgatgccgc ctatgaaatt gttgtagggg gcgttctttt 220681
ggcccgcggg cgcgccgcgt tggtaggcat ccagccgcgt tctgaactct gccatctcgt 220741
cgttggatgc gaacaacact agcgttcggt cggcgtcgct ggataggacc gtaagtccga 220801
gttgctccca gtctgcttcc tgcagtgccc ccgtcatctg gacgcggagg atcagcgctg 220861
gatttacgaa ttccggcttg cgtctccggc gttgctcgtc tcgggcagcg tttagctcgt

Figure 3 (Cont.)

220921
ctctgagctt tgcactgtgc cggggaccat ctctgtcagg cggcggacta cctccgccgt 220981
gcttgcgtcg ctcaagctgt tctggaagtc tgacgagctc gagatggtcg tacttggcca 221041
cggcggcctc agatcattgg tgcaagacgg gcttgtccgg cacgccgccg cgcctcgtcc 221101
tgaagtgcac ggttgaaatc ccgctcctgg acttgcttgc gacgctctat gatcattgct 221161
ttgatcgcct gagtacagac acgttcaatt tcggcgaagg aatagccctc gagtgcagcc 221221
gaatttcggg ccgggtcgaa cgcgacgggg acattcttga acttgagctt gaggaaacga 221281
ccgatcatcg cggcttcggg cctgtcaaac caaaggacct catcgaaacg gcgccagata 221341
gccgcgtcga gagagcggtc gaggttcgtc gctgcgatca gaaagccctt cggctgcatg 221401
ttgtcgataa agagcagcag gctgttaacg acgcgacgaa gctcgttgtg ctcgccactg 221461
tcgtctcggg tcctcgcgag ggcatcaaac tcgtcgaaaa acaggacgca cggctgcttc 221521
cgtgcgaact cgaatgtctt tcggatattt gtcgccgtct caccaaggta ggaagaaatg 221581
aggcgatcaa gcttcacccg gaacagtggg agtcccagtt cggcggcgaa aatttccgcg 221641
caaagcgtct tgccgcagcc aggcggtccg cagaaaagca ttttcgagcg gaccttgaga 221701
ccgtgctggc ggatctcatc tgcccgacga aattctttta ccaggccaag tagcaccctc

acgttggcgg cgctcagcac gatgtcgttg cgattatgtt cgggttcaat acgctcgacg 221821
aaatctgcgg cagcttcggg gaatgggatg aggggggcga gagctttcgg cgcagactgt 221881
gtccgctgag gaccagcctc aagcgttttc cgcaatgtcc gtgccaagac gcggttgttt 221941
tttttctctt cctcgtcgat gatctgctcg gcaacggcgc gaaaatcctc atcgcgcccg 222001
tagctagcca gcaatttttt catcaactcg ccgcgtgcca tctgtcgtcc gtctattccc 222061
ttatgctcga atcacagctc gacattatcc tgtcaggatg atgctaccac atgatttaga 222121
caataacctt ggtacggatt tagttttgtc gccagcgaat tcagcttgtg cgaagggatt 222181
gtccacgtcg ttcaacaagg tcgagggcag cttttcggtt tttcgtaacc ggctcgattt 222241
gatgagcgaa acgcccggag gggcgcagt cgctcccgcg gctccttcgg gccactatat 222301
tgccgctcct gcggctgctt ttttcccagc ctttgtgtga cgcgaattcc cgctgtcgct 222361
tggcagttaa acgtgagaat gcggctgttt cggccaggtt tggcatttga agatgagaat 222421
ccgaccgacc ggattctcaa attagctgca actgcgaaga cgtcatcgat cggcatgtat 222481
gggtcatgat ctcgtcgata gcgttgctga atcgcgcctt gttcccaccc atcatttggc 222541
cacgcagcat ttggagcatc tcgggtccgg cccgttcgac gatggccact ccggccagca 222601
gagctggtcg tagatgcagc ggtaggatcg ggcctcgaga gtgccttcgt ctgggagcgg

Figure 3 (Cont.)

222661
gaaggcgatt ggccagctct ttgagagcat gagcgacaac tctttcacgt gcactgtggt 222721
aaatcgtggc tacaaaggcg gccgtgatgc gcacatcacg gttcacaaca gcaagggcag 222781
ccgtcatcac ttcggcgaca tcaactactc atggcaatcc catagcgagt caaacacgtc 222841
aaacggtcac gtcaaagtcg acgcagacga gtacaacatg ttcctctcgc tgaacgattt 222901
catgagcagc gagaaaaaac gctatgacgc gaaacaggtc gccgacgtcc tctggctcga 222961
attcaccaat caggcaggga tcgaatatga ctgaggtgaa gcgtttccaa tgtctaaact 223021
gcggtcatcg cttcgagatt gacgtgttga cgccggatga gaaaaaggag gcaaggagga 223081
aagacgagcc ggtctaccca gtggcttgcc cgcaatgccg gcggaccgat gtaaggggtg 223141
gctggggcta ggcgccgttc aggcctcgcc gataaactgg attgggaggt atagctttgg 223201
aaccccccgag gaggaggtct cattgtcgaa cgatgcggaa cctgaaggaa ttggtgctat 223261
cgaccagctc tacgacatct tagagatgct cgaagaagat ataaaggatc tagagggagc 223321
gaggcgagag cgcgtaaacg tcttcttgta ccagggcatc tttgaggcga tcagtttttt 223381
ggacgaactc gggatggctg gtcggatagg tctatctgcg atggaactcg ataaattcca 223441
acgcatgtct ggcacaatcg acaacgcggt ccttcgtcaa atgaccggac gcttgaagag

Figure 3 (Cont.)

223501
tttattgcgg gaggcaaact gcctctatga ccgataatgg gggcgcaatg ctgccgttca 223561
cagacttaag ggacttaaga gtggacgtcg ccttcggggc ggacaggatc ctgctcccac 223621
gaaccctgca cggcttgttg ctgtgatgtt caccttttgg gccaggaaga tcgcataatg 223681
tatcgactgg cacttgccca gcttccccgg ggctggccgc tctttttgaa taacttaatg 223741
ttagccgttt ggcgatcagt aagctggtat ggtgggcccg gcggcaacca gtcggtcatg 223801
acgccgacgg ggcgctaacc aattaactac aggtcccacc aggacgtttc aagcacggaa 223861
aaaccgatgg atcagtcgcg tagcgggatg ctttgaagaa gtgttttgaa ccttgacgca 223921
ccagtgcggt tcatcgataa tcaaagtgaa ccaaggaagg ttagatccca tgaccgctgc 223981
gtttaccgtg cgtgtaaaag atgaaaccgc gagcaagctg gaccagctcg ctgagaagct 224041
ggatcggtcc cgctcttata tggctgcaga ggccatcgaa gctttcgttg agcaacagga 224101
atggcagctt gccgagattg aagccgggtt gaccgaggcc gaccggggtg agttcgccag 224161
cgatgaagat gtggcgaaag tcgtcaggaa gtacgtcaag tctgcccgcc aatcatgagt 224221
cggaagcgta ttcgttggac gctgcgggcg ttgcggcgac ttgatgagat cggcgcgtat 224281
atcgagaaag acgatccgga tgcggccgct cgcgtcgtgg cgcggattgg cactgccgtg

gatgcgttag cggagtaccc tgccagtggg cggcctggtc gtatcaagag cacgcgcgag 224401
ctcgtgctgg ccgacattcc ctacatcatt ccctaccgca taagtcgaga cgtcgagatc 224461
ctcaccgtca tgcacgctca ccagcaatgg ccgcaggttc tctagtcacg accaacaaaa 224521
cgcgtcggca cgatgagcga tgaatccgct catcagcctg cccgtttatg tagaagcaat 224581
ttctgcggcg gcgagcgcag tggctgcctt tttagtgatc gcttatgccg tgtaccaagt 224641
gtcggaaagc aagcgtgtgt gtcgacgcca gcataacaat gtctttgatc ggtcatgcct 224701
tctccccgtt tgagcctacg agccaccgcg atcttcgccg atccctgtac tggcgctcgg 224761
aaaaggcaca ggtccggcgc gaactcccca cggggcatcg atcacggcca atccgacggg 224821
gcacgcgtcc cccaggtgct cgaagcacgg ggcgatgggt cgttcccgac tagactaatc 224881
ggctcggttc gggaaggcta cgccaattcg ggccgtcgcc catggtgcag agaagttccg 224941
ctacgcttca cgtggccaca cactgcgagc atcccaagaa ccgcatgaga agggtggggt 225001
cggcggttat ggtgtggtcg cgacgctccg gctggggcag ggggcaagcg catcggtatc 225061
cgtgcggata tcggtacgca gccgatcgaa gaggcaccat cctggtcttc tcgagccgaa 225121
atccgggcgc catgcacgcc tagggccatg acgggcacac gacgatcctg ttcgccgcgg 225181
cccgccacct cgccgagcac ggcaagttca acggcacgct gacgctgatc ctccagccgg

Figure 3 (Cont.)

225241
ccgaagaagt cggcgccggt gcccgcaaga taatctagta ccggctgttc gagccgtttc 225301
cggtagatgc agtctccggc ctgcacaact ggcctggcgt cccgtcagga cagttcggtt 225361
tcgtcgaggg gccggcgatg gcgtcagcgg accaggcgct gatccgcatc gtcggacggg 225421
gcgggcaagg tgcggcacct catgaggcgg tcgatccggt gcttgcgcct ccttaatcac 225481
cgtcatggct gagccggaag gggcgccact gggatatcgc gtttcgcctc acctctaatc 225541
gccgtcggat gaaagttcga aacggataca ctcccggccg gcggcgaccg tggccggtgc 225601
cgttcgctca tccagcacga tgtcgagatg gtcgtccttg cgctggctca tggcggtgtc 225661
tctcatgctc gctccatccg tcgcatcggt cgacggcctt gcgtcggatc ggaccgaggc 225721
agcgcgcgca cgccgccgcc tgccgcgcgt tcaggcgggc gcatgctggc ctccccccgc 225781
agcgtcgctg cggtagcggc tggtcgaggt ctggtaatag tgcgcgcgga tggccgccat 225841
ggcctcgatc aacggccccc acggcgcggg aaaccgttct tccgccataa cccggtgcag 225901
catgcgcgta tggccggcca gttcgtcgtt gaggaactcc accacaggca tagccggata 225961
gcgctccagc agcaggatcg ccgcgttgtc ggcctcgccg gccgacctgt ccttgtcgcg 226021
tccatgcaga tcgttctgca ggcgccctat cgccgagatg agccgcagga cctggcgaaa

Figure 3 (Cont.)

226081
cgccggacgc gcgcgcaagg tcgccatgtc cagcccccac agcaacgaca ggcaacagaa 226141
cacgtttgcg taggcgatcg aatcgatgcc gttgtgcagg tactcggcgt aggaccagcg 226201
ttccgccgcc cctgccgcct gcgcgtgtcc ggcgcgcagc gccgcgcagt agcaccgggt 226261
atcgtcgaga agctgagcat agtcgcgacg atcgtaggcg agggcggcca gcgaagcgcg 226321
cagcacagcg cagccctcga atccggggag cgcgcacggc acgccctgcc ccagcgcctg 226381
ctccaccgcg gcgagctgct ccggcgcgat caggtcaagg tcgttgcaat cgtcgagcca 226441
gaacagcagc gccagttcgc gatagaatgc cacgatcagc gtttcgtcct gcggatcgcg 226501
accggtgcgg gcgctggtgt cgcgcaggct cgggtggatg cgctgcagga tgtactggcc 226561
gcccctgacg gcttccgcgg catgctcgtc ggcgaacccg gtcagggaac gcccccactc 226621
cagcacctgc tgcagcccgc gttcggtcgg gatcatggcg ccgctcctgc tccctcggcc 226681
gggacgcgcg gcccccaacg aagcgccagc cacaacccgg cgagttcggc cacgcgcacg 226741
acccggatgg ggcaatacag ttccttgccg atccacagcg gcatctgcgg caatgcaggc 226801
gccgcatggc gggcgagcat ccactccagc gcacgcgcca ccgcctgcgc gatgcgccgg 226861
cgccctgtcg gctcttcgct cccgtccatc acgtgcaacg cgaacagcgc ataggcggtt

tcctcgaatg tggacgcgcg accggcgccc cagccgccgt cgtcgcgctg cgcctgcagc 226981
agcgccgcca gcgcgcgctc gtcgcgccac tggggcttgc cttgcgccag cgcagcgacg 227041
gcatgcgcgg tgggatacag ccacgaaacg tgccattttt cattgtccca tagaccgtga 227101
gggttgcgat tggcctcgac gtaggcgctg gtgccagcgg caggctttcc caatagtcgc 227161
aacgcatgca gggcatggat gttggtcgac accgaggcgt tgcgctcgcc ggggaaggtg 227221
acgaacagct cgccgatttc gaaatggcgc aacgcatcga ccgccgggtc gcggcctgca 227281
aggcgcagga cgcacaaggc aacggcggtg tcgtccgcat cagccgcgaa gtgcaaggcc 227341
gggcccagac cgcgcacgcc caggcgggcg tcgagctgcg cgacgatcac gcgcaccgcc 227401
tcgtcgagcg cgggatgcgc gaacagcccg gccaaatgta gagtgtacag cgaccagcat 227461
ggctcgaaca cattgatcgg ccagacgttg ggaacgacac cttcgatgcc gctgcgcgtc 227521
gcccgcgatg ccgcctgcag atacgcgtcg gcgcgcccga cctgcggcgt gctcccctgt 227581
gtcacggcgt gcgcacgcca cgcagcggtg gccgccggac tgatgccgat gctgccgtcg 227641
tcatccgggc atgcggcggt tggccacgtc ccccaggcct cccaggagtg cagcaacgga 227701
tggccgctcg gcaacgtcgc caccgccccc agcttgacca agcacgcttg ccgcaacggc 227761
aacagcgcgg ggtggcgcgg aaacgccacg ccgcccaaca aggatgcggc ctcgccgcac

Figure 3 (Cont.)

227821
aactgcggca ggatcagctc cgcgccgatc ggcgcgtctt ccggcaccgc atgcgcgtag 227881
ggatcggcct ggcgctcgag gaaccgggtt gcagcctgga ctgcgtcggc agcgccggga 227941
agaggatcgg cacgctgcaa tgccagcaac gccgcccacg tgggcgcatg gcggaacagc 228001
gggaagtccg cgcttcccca tccgccatcg gcctgttgct gcgcgaggag ccacgcgtat 228061
gcgtcctgcc gaccggtgac gttgccgcca aactgcagag cccgcgccgt gtcgtagacg 228121
gacggaccga cgctgccgcc gtcgctcatc tcgctcagca ggtggcgcaa ttcgaaaagg 228181
atctgttcgg acagcgcatt cacgggggat gttccttctg cagacggttg acgagaacca 228241
ggatcgggca gacggcgcgc acgtcgccgc aggcccgttg cggcccgccg catgggcagc 228301
gccggacggc cgctctgctc cggcgcggcg atgagccccg atgcgggcgc cggttctccg 228361
ccgcatgggc ttgcgcgcag cgtgccgcgt gcgccgtgac cgtgctgggc aaccgcggcg 228421
atcggcgccg cggactcgga cacagtgctg catgcatggc tgccgccggc cgatcgcagc 228481
ggcacagggg cgactccatg cggacgggcg cgctcatgcg gatggcgcgt gcttgaacag 228541
gtacgcactg gcccgctgca gcatctgcgc caaccgttcc gcacgcggcc ccagcggggc 228601
aatggcctcc ccggcctcac acaacagatc cagcgcgaac tggcgcgctg cctgcagccc

Figure 3 (Cont.)

228661
catgatcgac gcgcaggtcg gtttctgcgc cgccgcgtcc ttgccggggg tcttgcccag 228721
cgtcgcggta tccgctgtcg cgtcgagaat gtcgtcgacc acctgcaacg ccaggccgaa 228781
acaggcgctg tagtgatcga gcgcacagta cagcgtagcg tccgcggcat cctccgcgat 228841
ggcgcatagg gcgcccatgc gaacggacgc acgcactagc gctccgcact tcatccggtg 228901
catcgctacg atcctgtcca gctcgacgtg ctttccgacc agcgacagat ccatggcctg 228961
cccgcctgcg gcaccctcgg cagacaccgc ctgcgccagt tcgcgcacga gcgcgatacg 229021
gttgtcgccc ggcgcatcca ggcttgccag ggtcaggaag gcgtgtgcct gcagcgcatc 229081
gccgaccagg atcgcagtgg cttcgccgaa cttgacatgc acggtcggaa ggccgcggcg 229141
aagcacgtcg tcgtccattg cgggcaggtc gtcgtggacc agggtacaag cgtgcatcat 229201
ctcgatggcg gcgccgacgt cgtcgagtat gtgcgccggc gtgtcggcca gtgctccagc 229261
agccagacag agcagggcgc gggtgcgctt cccgccatgc aaggtggcgt agcgcatcgc 229321
cgccataagc tcggtctcac cgtggtcttc ggcgcagaga agacgcgcta gcgcctgttc 229381
gacccgcttt gcgccgttct gcatccagat ctccggcagc agcctgccgg atgcgccgcg 229441
cgcccgcgcg cccaatccgc cgagggcgga aacgctagtt cggtcgtcgt gtagcgtgga

accggtctgc atgttgttca tgtccttgta cctgacagga gacggccacg gcgagcgtcg 229561
agccgccgcg gtgttgccgc gtcgcaccga acgcgcgcgc cgaatgcagc aatgccgcgc 229621
gtcgccggtg ccgctgcctc gccacacggg gcatgcgatg ccagctcatg agaatccgat 229681
gcggattgtc atggacggat gtgcggtcgg gtaatagcgc cggccttttt cgacgccgct 229741
cagcaacagc ggccgcaccc cggccttgtg catggtcagc gccaaggcga tggagaactg 229801
caccagttcc agccatacca ggtgatagcc gatgcaaacg tgtgggccgg taccgaactg 229861
cagcatgtcc accggccgaa tcggctccgt acgttgcagc caccgcgcca ggcggaactg 229921
atcaggcgcc tcgtgcagca gcgccgaggt cgagaaatgc agcagcggga tgcacagatg 229981
ggtgcccgcc ggaatgcgcc gttggccgag ttgcagttcc tgcagcgcgc gacgcggcag 230041
gagcgtcgtc gccggatgca cgcgcagcgt ctcgcggaac agcgcctcgg cgaccggaca 230101
ctgctccagg tccgcgtgcc gggtcggcac cgcgcctacg cgttgtgcct cctcgaccag 230161
ggcatcccac agcataggct gccgcgccag ttcgatcacc atccaggcca tcgtcgaggc 230221
ggtggtgtcg tgaccggcaa gcagcagcaa gcggatattg gcgaccagga ggtcatcgga 230281
gagcgcatcg tcgctgcggt cgaaggcact caccatgtcg ttgatcaacc cggtgcgcgc 230341
ggcatgcgcg cgtgcgtcgc ggacgaactg gcgcaactgc gcgtcgatcc agtcgcgggc

Figure 3 (Cont.)

230401
ggcgcggccg cgccgcaagg gcagtccagg caggtcgacc gagggcgcga cgatcaactg 230461
cagtagttgc cggtacttgc gatgccatcc cggcaggtcc tgcgcaggga ctcccatgag 230521
ggtgaagatg agcttgagca tcaggtcgcc ggtttcgggc aggatggtta cgtcgccgcg 230581
gtcgcgccac gcctgcaccc gcgcccggat aacgggcgcg aacaggtcgc cgatgccggc 230641
ctgggtcagc ccctcgggca ggaacgccgc cttaatcgca tcgcgcgcct gccggtgcgc 230701
gccgccgtcc tgggcgacca acgttccgcc aagcaattcg ggcgcgatct cttcgatcag 230761
cgccgaggac acgtccttgt gccggagcag tgcgaacgca tgcggatcca cgcaggtcat 230821
caggtgtccg gcagggccga aatccagcca gaagtggctg cccagcgtcc gttccgcgcg 230881
ccgcagcagg cgcggcaggt cgcagacgat ggcgggaaga tgcccgacca gggggaaagc 230941
gccgggcatg acggggatgt cgtaccgcag ccggtgccga cggtttaggg ggttgagcag 231001
cacgttcatc agcagcgcgc cgtttcggcg gtgtcgcccg cagtccgccc ggcgcagctg 231061
ttgccaccgt cggcgtacgt cggcatatgc gccagcatgc cgccgtcgat gcacacgacc 231121
tggccggtga tgaacgaagc atcgtcggag agcaggaacg ccaccagcgc ggccacgtcc 231181
tcggggtggc cgacgcgcgg caggagctgg tgccggctga gatgccgttg catgcacttg

Figure 3 (Cont.)

```
231241
tccagcttgg ccaggagacg ctcggtcatg atgagacccg gcgcaaccgc gttgcagcgg

231301
atctgcgcat ggccgtactg ggtggcgagc gaggccgaca gcatgttcat cgccgccttc

231361
gacacggcgt atgacgtctg cgcggtgtca ccgctgagcc cctggcacga cgacatgttg

231421
acgatcgcgc caccgccgcg ggcgatcatc cgtgggatgg cctgtcggca gcagagcagc

231481
gtgccgcgca gattggtcgc catggtctga tcccagaccg ccaggtccag gtcgaggatc

231541
gcgcggtcgc gcggggtcag atgcatggcg ctcgcgttgt tcaccagcag gtcgacccca

231601
ccgaagtgcc gctccgccgt ctcgaacagc gctgccactg cctgcgcatc ggcgatgtcc

231661
atggccatgg ccagcgcatt gcccgcttcg gccgcgatct gcgcggtgca ggcgatggcc

231721
gccgagccat caaggtcggc caccaccact ctgccgccct cgcgcgcgat ggcgagggca

231781
catgccttgc cgatgccggc gccggcgccg gtcaccacgg ccaccttgcc ttcaaaccgt

231841
tccatcgtgt cctcctggaa tgcgttggtc tttcgccgca tgccgctcgg cctccgccgg

231901
agaacgcgca gggtcggcgc tggcgcgctc gtcatcgcca gcgtcgcttt cgatgacccg

231961
aatggcggcg accgggcact ggctggccgc gagccgcacg gcggcgtgca gcgcctgcgg

232021
taccgtcgcc acgcacactt cggccacgcc gtccggttcg cgctggcgaa aggtgcccgg

```

cagcgtcagc acgcactgcc cagtggttcc gcacagatct tggtcaatca cgacgcgcat 232141
ctcagccctt gtacccttt catgcggttc tacggttgcg ccctgcgatc agtcgccgac 232201
cgcctctcgc cgtcgccatg ctcaaaactg gcaccacctt cgacccctct ctggccgttc 232261
aaaaatgcgc ttgttaaacg gggggagtcc ccctgagcat gcagccgcac cggcagcgcg 232321
cggaacgtcc taaggaacgc ggagggctcc cgggtcggct gctcggccac tgtcagcgtg 232381
gggaagcgcg cctggattcg cggcaggctc tcggccaact gcacccgggc cagttgcgca 232441
ccgaggcaga agtggatgcc gtggccgaag ctaagcatga tcttcccgtc ggtcgacatg 232501
ccaggactgg tgccgtagaa ccgagcggga tcgaagcggt cgggatcggc gaaggcgtcc 232561
gggtcgcgat tgccggccgc gatcagcacg cgcacgtccg cgttcttcgg gatcaccacg 232621
ccgctcagtt cgatgtcgct ctgggcaata cgcggaatgg agctgaacat ggcgggggcg 232681
tcgcagcgca ggacctcttc gacgaatgcc tccacccccg cggcgtctcc ctgcagccag 232741
tgccgctggt cgggatacgc cagcatcgcc aggacggcat ggtcgatggt cgcagcagtg 232801
gtggcgaagc cgcccagcag catgccccac agcatgctga tcaactccgc atccgatagc 232861
gtgtcggcat cgtcgtcgtg tgcgccgacc agcgtggcca caatgtcgtg gcggggatcg 232921
atgcacttgc gctgtatcag gtcgccgaag taggccttca tcctggcgct ggccgcgtct

Figure 3 (Cont.)

232981
gccgcggcga gctggggatc gctggcgtgc gggctcaggc cttccagaat ggcgccgatg 233041
ccggcggcga ggccgaacat gtcgtcctgt ggcatgccga acagttcggc gaagaccagc 233101
atgggcaagg ccagcgcgaa ttgccgatgc aggtccaccg cctccccgcg ctccagcgcg 233161
ggcgccatgc cgtccaggcg cgctgcgacg aagcgcgcga tgctcggccg caggttgtcg 233221
atctcgcgca tggtgaaatc gcgcgagatc agccggcgca gacgcgtatg cgtcggtggt 233281
tccttcatcg ctagcgtgga cgccagcaga ttgagcgaca ggctggtcgc cgcacgcggg 233341
aaatagcgcg ccagttcgcc cggcgccggt ccccgaaacg cgtcgcccgt ggccttgagc 233401
gcccagcaga tgtcggcgtg gcggctcaac agaaagaggc ccgacgccgc gcgatgcacc 233461
ggatcgtgct cgcgcaacca gcgcatgaac ggatacgggt cgtcgatgca ggctggcgac 233521
gccagttcgg caaaggcgtc cgcgcatgct gtcgtggttt cttgcatgtc catcttggtt 233581
acctgtcggc tggctgatct gacaggcgcg ccaggcgcgc ctgcaaattg cggagaagat 233641
cgcgattccc ggcggcgtcc gcgcatcacc agagcaccgg gaactcctcg aatccgccag 233701
tgatgatctc cttgcgcaac ttcagttctt cgggcgccac ggccaggcgc agcgcgggaa 233761
agcgctggaa gatcgaaccg aacaccacct tgagttccag cctggccagc gccatgccta

Figure 3 (Cont.)

233821
tgcagtagtg cggcccgtag gaaaacgcca ggtgcggctt tgcgtcgcgt ccgatgtcga 233881
agatttcagg gtcctcgaaa tggcgtggat cgaacgatgt cgccggcagg ccgaccagca 233941
ccttgctctc cgcgggaata tgcacgcccg cgatggtcac gtcggtcctc ggatagcgca 234001
tgatgccgtc ccagcccgcg cccggcgggt acatgcgcag gatttcctcc accgccttgt 234061
ccaccaggga tggattgccg accagacgtt cgcgctgttg cggatggcgc aacatggcca 234121
ggaggccgaa ttcgatctgc gcgacggtgc tctcgtgtcc tgccaccagc atgcccgccg 234181
cgaggccgat cgcctcttcc tcggtcgcct cgccccggtc gaccgccgcg agcagatccg 234241
tcagcaggtt gtcgcccgga tcctggcgct tgtcccgcat cttgccgcga atgtaggcgc 234301
gcagttcttc ccaggccagg cgcgacgcgc tgcgcgggcc gctttcatgc tggtgcgtca 234361
tcacctcgtc ggacagcccg gcaaaaaagg cgtgatcctc gtagagcacg cccatcagcg 234421
cgctgatgac catggccgga agcggaaagg agaggtggcg ccgcaggtcg gcgggctggg 234481
gctgggccgc cagagtctcg aacaactgcg ctgcgatcgc ctcgacttgc tgcgcgagca 234541
gcttcaccct gcggtcgctg aaggccggcg caacgatcgt gcgtaaccgg gcatgctcgc 234601
ccccttcgtg cgagaccagc caccccggcg aaccgagaat cacacaatcc ggggtgaatg

ccgccggcgg cattcccgca ggccggaacg ccgcgtcgga cagcaccgcc ttcgcctcgt 234721
cgtagcctgt cacccaccag ccttcgtgcc cccgcgggaa gcgcacgttg tgaatcggac 234781
cgttggcgcg tagcgccaac atcgtgggcg agggctcgat gtgatcaacc cgccacatcg 234841
gcagcgtcgg caagggttgt tcgggcatgg tggcactcca ctctctaagc gatggaaggg 234901
catgccggcg tgtgccgccg tacaactagg gcagcaagaa ccgcgccaac tgcgcagaga 234961
gcgcctcagg tacactgctc tgcagatcat tcaatgtctt aactgagcgc ggcacgcccg 235021
ggccgaacat caccatgtcg cggacgcgac aaacccgaca gtagatcgac gcaaagtatg 235081
tgggtcgcct taccttggcg cagaagtcag ggttcgtctg tcacgcatga tcggacctcc 235141
agtaaagcgt tcacgctatc gtttggtagc taatcatgag gatgcggctg tttcgcctta 235201
gttcggcagg gtaagttgcg aatgaagctc aaacgaaatt tgccgacgac agggtttttt 235261
gcttccagct catcatcacc gaaaatcctc cgctgacgta actgatcttc ctgcctttcg 235321
acgggttcca cttgccgaga ctgacgaccg ttgcggaatt gtgcgtggag cccgtcgcgc 235381
agaaagaccg acggaaagta tgacaagggt ggccaggcga aaagtggagc gcgcaggcca 235441
catccgatac agggcgctgc gcttcaaata gtcacttgcg ttcatgcgtc ctctccttcg 235501
cgtcaattgc gacggagaga ccctacgcta tgccgattag gctaccgcta tgctaccgaa

Figure 3 (Cont.)

235561
aacgttggca aaaacttgct taatcggcat agttggacgg tcggcataaa cggccaaaat 235621
gaatgccgtc gatccgctcg acgggctctc gcagaccttg aatcgcattg ctcaaggctg 235681
gccagcatcc gaaattgaag ccctcatgcc ctgcacttca agcctgacgt tatcggctga 235741
ccgcttacgt cgaagggcag gtcatggcgg aagaactctt cgccgcagag atactggaaa 235801
tacgggtttt ccacccaacg ggcgcacagc tcctcgtccg acaggttgaa cgtatgcttg 235861
aggatcgcca gcccggccat cagccgcgtt ggcggtggtg gcatgccggg gtcggaatag 235921
accgcgccga agcgccgctc caaaagcggc tagtcgatcg cctgcgccag ccgcaccagt 235981
tcgagcgtca tgttgatgat ctgatccaga cgggcatgga acaggtcctg ctctcccgta 236041
tcgcgccgct cgcgtggtct tgacatcgcc gctcctcgat tcaccgccgc tagtacgagt 236101
gaatcacgcc gcgccgaagc agaaaaccgc aaaatcatat tgcaagaaaa gcggactcag 236161
cgagagcctt tcggcaacac tgcgtcacag gaaagcgaag aattaccgca gagaggcgtg 236221
ggatagttca cggacgactc ctcaagagta gttgcaaatt acggctatcc acgcgcggag 236281
aaatcgtctg ctgtccgttc taatagcaaa acttcagaca accggcttta gaggtgcttg 236341
acgtttaacg atccgcccca cttgtcattt aagtattcgc ataccaatcg cctatgacag

Figure 3 (Cont.)

236401
ttatgggggt agcctctgaa caaagcaagc acgtgccctc aaacatctcg ggcttgaggc 236461
gattctcaat ttgtcgcgtt gccattaagc gcatgaattg cccctcgtag actttccagt 236521
cgcctttgtc tcgcttctaa gccttcaaaa tatcatcggt aggagccaaa aggggctgat 236581
gcacgtactg ggcgccgcat atctctgtta ggaagtatgc caggtcatca gccttcgcga 236641
accctgcgag ctgaaaacgg caacatagcc gaggtcctgc agcatcgcag caaggaccga 236701
acccaacacc ggcccatcgc catcgtgggg agttcccagg gcatgggcgg cagcaaaagc 236761
cgcgccgcat cgctcgccag gctgtctttc gcaactccgc gcctgcgaga cgattgcctg 236821
cgaggcggcg agcgcttcac gcaacttccg gccggcaaag accttcttat tgaggagcgg 236881
cgtgggccag cccaagacca gagggcagag ggtctcgaag atccgctcgg ctaacaggcc 236941
tgcccctgcg gccatgcgct cctcgtcgct cgtcggcatg tccgtcgcat tgaggacggc 237001
aattctggac gcaagcgatt gcgaaaaact gcaaagcgaa aagacccgtc ccgccagtgc 237061
gggcgcctcc tcgcctgcgg ccgacgaaca tgcgggcgag ccgccgcggc cggttcggcg 237121
accgaacaag cgagcgcacg cgacactgta gcgtcgatcc gtatcgtgcc tgcaccgacg 237181
agatagctca tttcatcatg ctcctcgttc taacggaatt tgccgcgaaa caggtcgcgg

cgattgagag gagccgtagg ggccgggggc ggttcgatcg cggacggatc gaagaaggcc 237301
cgtatggtct gctcggcggt ttccagcgcc gcctccgtcg tggcgaattc gaagaccggc 237361
gaaaacagtg aacagagatc gacacgcccg atcgtatcga gctcgccggc gttgaagcga 237421
ccgaacgggg agcgggaaaa acacaaacag acatcttgtc acgcagatgc gaagcgtccc 237481
atagttcgcg cagcaaaagg gggagacatg ccgagcgtct ttttttcata ttcgcacgca 237541
gatgaggggc tgagggatca gctcgaaaaa cagctgtcga tgctcaaacg acagggcgtg 237601
attgagacct ggcacgaccg gcgcatcggc gccggcgaag atatccatcg tgcgattgac 237661
gatcacatca atacggacga catcatcctg ctgctcgtca gcgccgactt catcgcatcg 237721
gattactgtt acgacatcga aatgcagcgt gcgatggagc gccaccacag cggcgaagcc 237781
atcgtcattc ccatcattct tcgggcatgc gactggcacc acgcgccgtt tggaaagctg 237841
aatgcggttc ctcgggacgg caaaccgatc acgcaatggc cggatatcga cgaggccttt 237901
ctgcaagtcg ccaaggccgt gcgcgaagca gcagggcggg taacccgaac ggcctcggct 237961
ccgcctgcac gggccgctgc ggctgcgacg cctgcggcgt cgccggctcc tcaatccctc 238021
ggcccgcggt cgagcaatct gcggctcgcg aagagcttca cccaaaggga caaggaccag 238081
ttcagacacg acacgttcga atacattgcg cgtttcttcg agaactccct taaggagctt

Figure 3 (Cont.)

238141
ggcgagcgaa acgccggttt cgagggcgtt ttccgacggg tcgacgcgaa caggttcttc 238201
gccaccatct accgcgacgg caaggatgtg tcacggggca ccgcctatct gggtggggag 238261
acgtggggac gaggcatcaa ttacgttcac ggtgagacga ccagcagcaa tagctcgaat 238321
gagtccctga acgtcgaggc cgacgatcag acgctcttct tgacaagtat gggcatggcg 238381
tcgtttgggc gggatcgcga tcagaaactt tcacaagaag gggccgccga actgctatgg 238441
gcgatcctta tcgcccctct tcaggggacg cgctattaag ggaaagcata tgctgtcacc 238501
gagtgaattc acgatcggca cgctggggag cgccgcgcct ctcagcctta ttctgccacg 238561
aacgaaatac gaggcgacca tgctggtcgg ccatgtcgac aaagcgcctg cggctgtctt 238621
tctttcagga gagtttgctt tccattactt tccgagtacg gacaatgaca gttggcgagg 238681
ccttattgtt ccgggcgtcc gcgtagaggt ggacgagacc agtgtcttcg atcagggcca 238741
aaccatggct cccttgggcg cggctatccg aatcgatacg cgtcttgcca tacgggcaaa 238801
gagcgagcat tcactcagcg gatcatccgc ccttacgatt cacgataagc tggtatcggc 238861
cggagacctt cgcgcggggt tcacaaggtg gcagatcgtc atcggggaag gacagacgaa 238921
gcgggtgctc tggcaaagat ccgacgaaga cgaagccgct aaatcatccg cctgatttcg

Figure 3 (Cont.)

238981
gccgccaacg gcgccaggtc gccgctgaag ctccggatca tggcgtccag aaaccgcttc 239041
ggctccagct tgctctcgtc gagctcgtat cccgcatagc gagtgagcat cgtcaggaag 239101
accagttggg tgcggccgtt gccttcgcga aatggatgaa tcgcgttgat ctccgcgaga 239161
aaccagcttg cgcctttggc gaaggcctcc ttgctttccg tcctggcaag gtggtcgcga 239221
gcggcaagtt cggcaaatag gcgattggct tccctttcga tatattccgg atagcaaaac 239281
cagttctcac ccttgccggt gcggataatc cgtgtttgcc cggcccattc ataaacgtcc 239341
tgaaagaagt gtcggtgtaa cgcgcgatag tgggcgaaat ccagatcgcc gtccggaagc 239401
gcttcccgcg cacgggaatc gaacatcaat tgctcgaact catccagctc attctgatcc 239461
gggatattcg ccctgttgcg cagcacatgg gtgccgggat agcacagcgg atcttcgacg 239521
gcattgtaac ggaccacccg tcagcccttc ttaaaggcct tgacgatctc gctacggtag 239581
gcgtcaccct tgaggccgct cgcggtcagc ttctccgaaa gcgcctttga cgcggcattc 239641
atcttcaagc cttcgacctg ggcgaatttc gcggccttct tgccgccgat gggctgcgtc 239701
acgaacttgc ctgtcacggc cgagcgggct gttttcgtat cctttttcat gactcacctt 239761
accatcgacg cggaacggtt gcctacttct ttatggcctg cccaggaaca ggtcctgcca

actgccttgg ccggtattcc gcctctctcc tgttctttcc gacgcagaac acggcatgcg 239881
tgagggaaag gggaattgcc gagaaatccg tctgtcaccg gcggctcact cgatcttcga 239941
tcgaaggctt gttctcaccc ccatgggatt ttcgtctgga gcctcggacg ggtcacgccg 240001
tgttcccgcc ctggtcaatg cccgtacccc cgctggccgg attggcgcca aactgggctg 240061
atccctgccg cgctcaatgg accttccgcc gcaagcggtc tcccgagaac gccattgccc 240121
gcgccccgtg gtgatcattc ggcgaccggc cgcagaggtg gccggatcaa cgaagagaaa 240181
aacaccaatg gcgaatacca acacacctaa gtcacccacg aatcttccat gtcgtcggcg 240241
agaaggacaa ggcccgctga accaagatcg gtcggctggc agcacggcga tagcgacgga 240301
ctcaacctcg ttaatactac accccactgg tcgcaagccg tatggtcgcg cgcaggatca 240361
aaacgcagga gcccgatgta tgagcacggc cggtttcagc gggctggcgg agtcaacgaa 240421
cttcgccaat atcaacgcca tcgggtctac ttcaccgatt ttgaggatta tcaaacaaaa 240481
gtcgctaccg ccgtttatgc tttcggtcag ccaatcgagg agctcgagct gcaatacatc 240541
gacggcgagt tttcccgcct gttcgaggcc gtccgcgtct ctcaagccag cctgatcgct 240601
tggtttgacc tgcttgaagc gctcggtggc gacgaagacc gccacctgat cgcccgccac 240661
cttgccggtt tgggcaatgc ggtcgacgag cttgccgacc gctgcgatga ttacacgctg

Figure 3 (Cont.)

240721
ttcggtggga ccgcggcaga ctacgtggct gaaatcgtcg agaaatgcta cgacgtttcg 240781
atgcttcgga atttcgtttg atcgagaacc tgtgcccggt tgcgagtgac ctcgccacgc 240841
tcggcaacgc cgtagcggca ttgtcgcgtt tcacgacatt cggcttgccg atcttctcgg 240901
cccaccagcg caaccagctg gtagttttga cgctctggct atcgatgacc agccgtcggg 240961
cttgcctctt tgccctccaa ctcccgggct tctatgacga gacgatggtt gatgcgtggc 241021
caaagtccaa gcaccctcca aggcccggat gctagcgctg aaaactgcct tgtcgccgtc 241081
tccgacgccg gttcaatggg cggtggagac gatagcgggt atcgcgaccg ccagcgccgc 241141
ctccgaacgc acctggtgtt ttgcggtgcg atcccggcgc ggtagctgtc gtcttcatgc 241201
ctccgagtga aggggcgtga gtgtgcacgg aacgaagcat cacgatcgtg gttcggagct 241261
tgcagttttg caagtctacc cgaccaggcg gtgcctgcct gctcactcgg aagcggagaa 241321
ataccgatgg cgcacggtac gaagcaaaag ctgatgaagg caagcgacat cccagcgttc 241381
gtgaatgaag tcatcgaggc cggatgtgac atctgcgccg ttggccacga aaaatacgtt 241441
attggagata ccgacctgtc acggggcgcc tatggaaaaa tgagacagag gctgggtagg 241501
atcgaagaag cgtacggcga tcgtgatttc ctcaaactcg aaatcgtcgc ttacctgcgc

Figure 3 (Cont.)

```
241561
tcaattggca gatatgtcga cgtcggcgca gacggatctg aatagaaagc gcgccacatg

241621
ctcccgcaga tgtgcggcga aatgccgggt agagcgttag tctaatggtc caattgccgg

241681
agcatcttcg aagccgccgc ccgtgaagcc gccgcttcgg ttttctgata gcggtctgtt

241741
tcgtcctgcc cgatcaattc cgccgaacgg ttaccgggca atctcggccg cactgggcgc

241801
ccgccgcgag atgatagtcg atgtgacgag cggccttgcg tgcatcatcg ctcggctgcg

241861
gaaatctcgc tgcgagattt aaggagtgcc attgcctgtg aagcgggcag ggggccgcca

241921
aacagataac cctgcgcctc atcgaagcct tcggccttta tcgtgtcgag ctggtcctgg

241981
cgctcgacgc cttccactgt ggtgataata ccgagtgagc ggccgatggc ggccaccgcc

242041
ctgacaattg ccagggattc cttgctcttc ggcagatcgg cgatgaagct ccgatcgacc

242101
ttgattttat cgaagggaaa ggttctgaga taactcagcg atgagtagcc ggtcccaaaa

242161
tcgtcgatgg cgactatcac accgagctgc cggatctcct tcagcgtctg aagattactg

242221
tcgcattcct cgagcaacac cgactcggtg atctcgagct gcaggcgcga ggcgtccagc

242281
cccgtgtctt ccaaactgtt gcggaccgtc gaggcgagcc tctggttcct gaattgcagc

242341
ggtgaaagat tgaccgccac actgacatag gggggccact tgacggcctc ggtacaagcc

```

tgacgaagga tccactcgcc aagcgggcca atcaggccgg tttcctcggc aaccgcaatg 242461
aactctgcag gagacacctg ccctctctcc ggatgtggcc accgggccag cgcctcaaat 242521
gtcgtgatct ggcctgtgcg aaggttggcc agcggctggt agcggacttc cagctcgccc 242581
tttgcgagcg cgtgccgcag tgaaaccttc atccgctgtc ttgcccgaag atcagcgtcc 242641
attttgggct cgtactgaac gattgtgcca ccgccgccgg ttttggcccg ttcaagcgct 242701
atatcggcgg tcttgataag ctcgtctaac gactggtcac tcttcgaagc cgcggcaagt 242761
ccgacaacta cctgaagatc gacatgcgtc cctgcgagtt catagggtgc ttcgatcaca 242821
tcgatgagct gctgcgccaa taaacgagcc tcagcattgc tgttgatgcc aacgcgcaag 242881
acgacaaatt cgtcgccact gaggcgacag aggatgtcgg attgcttgag aaaatttctg 242941
agccgctcag tcacatggcg cagcagcagg tcgccggtgg ctcgcccata agcgtcattg 243001
atcgccttga agccatcgag atcaaggcag agaattgcca gcctcgtgct cggcgcaata 243061
tggtccgaca ggcgctcgaa ctcctcgcgc aggaactggc ggtttggcaa gcctgtcaac 243121
gcatcatgcc gcgccatgtg gtgaatttgc ttctgcgcca gcaatcgctc ctgttcggcg 243181
ttacggcgct cggtgatgtc gagcgcaatg ccaacgaagc cgagaaacgt tccgtcgctt 243241
gcgaagcggg gctgtcctat gtcgatgacc caggccgagc ctccgccggc acgcttcaga

Figure 3 (Cont.)

243301
cgatattcca tccggactgg ctcgcgaagg tcgaaggcct ggtaaaatac tctttcgaca 243361
gcgttccggt catcgggatg gacggcattc aaccagcctt tccccgccgc ctgctcggcg 243421
gtctgtccgg ttgtctcgag ccagaggcga ctgtggtagt cgtcggcgcc gttttcgccg 243481
gtcacccaga tcatcaccgg cgcgtcgtcg gcgattgccc ggaaacgggc ttcgctctcc 243541
ttcagggctt cgaacatctt gcggcgatca tcgatgtcct cgactgtgcc gtaccatcga 243601
aggatgcttc cgtcttcggc tctgcgtgtg gcggcacgac tgcgatacca actgtagcct 243661
ccctccgcag ccgccaggcg aaactccaca tcgagcggct ctccggttgc aagcgatttc 243721
gcccactctc gctgaacctc gcccaggtca tcagggtgca tcgccttcgc ccatcctgct 243781
ccgagagctt cctttggggc atagcctgtt ttctcccagc gcggaccgat ttccaggacc 243841
tcgcccgatg gatccgctgt ccatggcact tgcggatgca gttccgtcag cgatcgatga 243901
tgctcgacgc tcgcctgaag cgccgcttcc gccgttcggc actcggtgac atccagggcg 243961
atcgccacaa taacctttc gcttgagctc cctctcgtca ggatggcacg actcttccga 244021
gttacaaggc gccttacttc tccgcccggt acggcaatcg gctcctcgac ggagacctcc 244081
tccccggtag aaagcacgcc aatgtccatg tcccgatagc gatcggcctc tgccgtcgga

Figure 3 (Cont.)

244141
agaatgtcgt aatccgtgtg gccgatcagg tcgcatcgtg ctctgccgac aagcatgcac 244201
gcggcatcat tgaggaagag aaagcggaaa tgctcgtcct tgacgatgat gggctgtggg 244261
atcgcgttga ggattgcctc aaaatcggcg tcgaaagtca actggttctc gaatgaagtc 244321
cgttgcatcg tagggctcgg tgttggagag gtaagttaat gatgtcggtc ccggccgagg 244381
cgggccttaa caatcgttca gatgcgaaat ggcgcataga cgccgcgtca aacaccctag 244441
agtagcagcg gttaacaata aataggccct gtcggctcga agctgggatt ttggccaagt 244501
tgaataacgt tgtgggaaca ctgccgcggt gattgacgtg tgatttgtcg ggaacgaca 244561
tttcgctccg atttatggag tggagtggcg agtttgagcc tttcgcatga agatttggtc 244621
agccgctgga gcctgagttt ttccgatata gaatttgtaa ccggcaagtc ggtatcggcg 244681
cgccttgggc tggcggcgca gctgaagttt ttcatgacct acggcctttt cgtacaggat 244741
cgcagcgcaa tccctgccga tggtctctca tacctggccg agcagcttgg atttgatgac 244801
gataccccga gcgaatacga ttttggtggt cgtaccgcgc gccggcattg ataagcgaag 244861
cgtcctcaag gccgggcttt atcactgcgc ccgctgatcc tgtcggtgaa tatcctcgag 244921
catcccgccg ctttgagagc gcgctgttgc atatcgaggt tctgtcagca atgaatattg

aaaagcttct cggcggcttc gctaacgtcg ccgccatcct tacacctctg gtcgcggttc 245041
tcgcttatag tcgctttctt tgggagcggc gtcagaagcg cttgcgcctg gagagctatt 245101
tgcgcgaaca gaaattattc gagtgcactg gccagcattc gttcctgcac ttggtcgcca 245161
ctctcggaat gttcgaagcc gatatcatgg atgcgtcgta ccgcagcaag gttatcagtc 245221
gcaacgtcgc cgtagatgtt gcgggagagc ctgtgaggat cgtccttgaa tacgagccag 245281
acgacttgga aaaggaatta cccaagcggc ctggccgcgg acagttctaa aaggaaaaac 245341
ggttcgtgac gtcaatcaga ccatctgttt tcaaccaacg ggtaacgccc gaaggcggac 245401
catttctgca tttctacgat catggcgaaa cagcggaaac gcttgacgtt tacttcagtg 245461
acgtgaatcc cgagggggag gaacaccaga gcagactgct cctccgagtg tgtccagaag 245521
ctatagtgat gtggccgatt aacgttgggc ggggtagcca aaactactta gagcccaaat 245581
atgcctctct caccgatatc tggattcctc gtccggcctc cggcccatat cgattgccga 245641
agacgtctga agacgtagac gaacttttag atcgccgcct cccgaatggt tttgagacaa 245701
acgggcgact cggcttactc ctgtacaaat atcgatcgat ttgccgctcc atcgcaggca 245761
ttgacggtat caccactctg gttgttcatg gccaaagcgg agaaagggac gcaattatac 245821
gccccctaga atacgttctc ggcaccaagc ggtttcatgc cctgaagcgc gaattgacca

Figure 3 (Cont.)

245881
ggaccacgaa tcgtttccgc cgcgaggcca gaaacgcgag gcaggaccgt atttacgaag 245941
ctcttttgca ttcagcggat cgcgaacgct tccctcggaa aaccagaaga accaaaccgg 246001
atgccatctc cgagctcact cagggaggcg cgaccgacgg gatatcgaag cgagatcgac 246061
gcaccgccgt ccgactcgta cgacagagcg ttaacactct ggccaaagac gagccccatg 246121
tattgctggc gctatagagc aagattgagc tcattacgct gaagggactg attgaccgat 246181
ttaacgaaat gctcgcaaag gagttgcccg aatcgagatg gcaagcgttc ctttaagata 246241
atcccttcat tctcagcatg gcgttttccg cgccggcgat catgatccag gataatgctt 246301
acgtcggcgg taagcgcttc aatggtagca acggcaaatt tgccgatttc ctgatggcga 246361
ccgcttcgac aggcaatcgt aaccatccgg cgaagtcatc accggagggg tacaggcaat 246421
ctggccctga tcgaaatcaa gaggccccaa atcgacttgc tgaccaagag cgcctatcga 246481
gggactgatg tctacggccc atcggccgag ttgaacggag ccatatatca ggttctggac 246541
tagcgattcc ggcttcatca gaatctgccc atcttcaagg acgaaactga acggaatgac 246601
attcatgtca ttttgcagtt aatcgtaaga ctcagatata gcgatatcaa cgacttgacc 246661
cggcacataa atcgagaata ggcaattaaa ttgagaatcc cacgggattt tggtacttaa

Figure 3 (Cont.)

246721
tctgcgaacc gccgcgatta ctaaaatggc gattttggct gaagtccgct tccgcgtatc 246781
attcgtttga atcgaggctc agcgccacgt tgcgctccga atgagcgatc gcactttatt 246841
atctgtcatg gtgaaatgct cacagatggc gcaactcagt cgaaacaagg cttcggatac 246901
gcactgaatg caagcagaac caaaagctgc cgcatcggaa gccggagaaa tcctatgagt 246961
catcgtgcaa tgtctggttt agtatggtct cggatcttgg tggccctcga cgtttcgata 247021
gatgcgctgt atcggcggga gtctcgctgg acagcgaagc ctttgaggcg ttcggctaat 247081
gattcggttt tgggatcgcg cctgctggtg ctcaagtctg tctcgttgat gccaggttgg 247141
tggcctgcaa tctcgtcaat tacactgctg gagtgagagt gcttgtaaaa ggtcgctggg 247201
aggaacctct ccccatgaaa aaggcttatt tgcgcatatt ccagcatggc gtcggggcat 247261
gtagtcactg gagtagtcac cttcgtgggc tatcgttcca tggtggtgta gattgtcatg 247321
ccaggcatcg aacgtcggta attctcgata tgcggccagt gcaaattgta ctccgaacat 247381
cacgcagtca gccgcagact tctgcgcgcc aacctcaata aaagcccact tcgcctgcgt 247441
tcccaactgc cgaaacgaat ccccccgcaa tttgaaatac gaggcgacaa aggtgtaaaa 247501
gttggctccc tccatcacga taatggtggg tgctgctccc gcgcgtgtcc gaacatcagc

ggcgacgtgg tgctgctcgc cgtccgccaa ccgcacgaca gcacgccagg caccgtccga 247621
tgagcggtca ttcagcgcgt cgaaaaatct agcaggcgag tccatgtgtc taaggtcaag 247681
gtccgggtag cgccggttgt agctggccgc caagagagga agattcctga tgtccaacga 247741
taaaattttc tcgtcaggct gtacgttggc agacaaatgg cgtgctacct gccgaccgta 247801
ttccatcaga ctggatgaca tcccagcccg cctggcatgc tcaagtgctt ggccaagcaa 247861
ctcgactttc tcgttgattc ggggtgagag attacggctc gacggatttc caatctcggc 247921
ccgccgagat aattgcaacg aatgctggcc ttcaagatgg ggttgaggtg gacttgatcg 247981
tgcggcctca acgtaagcag caaactaggt ttcttggccg tgtccatagt cctgatggct 248041
ctggcgccgt acgctcagcc gggaaatgca accacccata tgcaagctcc tgtgatacgt 248101
gtttacccga tctggctctt caaaaaaatt catccgcgaa aacggattaa ggagtcgcga 248161
tcgcatgcaa ccgactaacc gcattcatga tcttccggca ttaaacttgc acggcctcac 248221
cgtgatgcag tccgctaaga tgcggctcaa aagttcgctg acgcgcctgc tgcaacggca 248281
tggtgcagaa tggcgaaatc tggaccatcc aaagggttga tatcatcaaa taggcagtcc 248341
caattcgttg gcgtggtgac gttcgcagat ctgcgtattt ggatcgctac gttctccaag 248401
ttaactgaat tagctttcga gaagctgacg gctgaactgg ctgctgggcc gtgggcttcg

Figure 3 (Cont.)

248461
tgcagccgct ggagcctgag tttttccgat atagaatttg taaccggcaa gccggtatcg 248521
gcgcgccttg ggctggcggc gcagctgaag tttttcatga cttacggctt tctcgtacag 248581
gatcgcagcg caatccctgc cgatggtctc tcatacctgg ccgagtagct tggatttgat 248641
gacgataccc cgagcaacat cgccatcgcc tcgatcgacg aaccggcggg gcgggtctgc 248701
gatgttatct tccaaacgcg acactgtcga tccgcaatgc ggacgtctgg ggtgatgcgg 248761
ggacggcatg cgcctccgat tcgacgaagt tcggcgcatg ggaccgcaat ctgatgacgg 248821
aatggcatgc ccgctacgga ggccggggtg tgatgatcta ttggcatgtc gaacggcggg 248881
caacctgcgt ctattcgcag ctcaagcgat gctcgtcctc ggaggttgcc gcgatgatcg 248941
acggcgtgct gcgccattgc accgacatgg aagtccagcg tcagtacgtc gatagccaca 249001
gccaaagcgc cgtcggcttc gccttttgcc gacttctcgg ctttgagctc gccccacgcc 249061
tgaaggcaat cgcccggcag aagctcgcgc ttccggatgc aggcatgcgg acgcggctac 249121
cgaacctcct gccgatcctt tccagcgtga tcagctggga agagatcgag cagcaatatg 249181
acgagatggt caaatacacc gccgccatgc agaccagaac ggcggacccg gaggccatcc 249241
tgcggcggtt tgcccgcgcc gaggtgatgc atcccaccta caaagcgttg agcgagctcg

Figure 3 (Cont.)

249301
gccgcgcggt caagacgata ttcctgtgcc gctatcttcg ccaggaatcg ttccgtcgag 249361
aaatccacga ggggctgaat gtcgtcgaga actggaacag cgcgaatggc tttgtgttct 249421
tcggcaaggg cggcgagatt gccaccaacc gggtcgaaca ggaaatctcc gccctggctt 249481
tgcacctgct gcaagcttca ctggtctacg tgaacacacg catgcttcag accatgctgg 249541
cggaaccgaa atgggccggc cggatggcac cggaagacta tcgcggcctc acgcccctca 249601
tctatagtca cgtcaatcct tatggccgtt tcgatctcga cttgaatagt cggatcgact 249661
ttgatcagct tgcggcataa tttttggaga cgataatggt caagattgct gaagcatgcc 249721
tgaatgttct ctaccagcac gggttgtcgt cggcacagtt ccaattttgg ttcgagagag 249781
caaagcatga tctcttggcc gatggcatgg cctgcgacgc cattgttgct gaggttatgc 249841
agtccatgga cgatcatccg gacgcggcaa ccttgttcgg gttgctgctg gatgaggccc 249901
gaatgggcat cgagaatgac agcccatatg gaaaggcctt cctggaaaat gcggagaagg 249961
cgatcagagc tcgcattgcc gccgacgctt tcgaaccgct tcaccgcttg aaaatcgctg 250021
gcttgtatcg gcgtgccggt ctgcccgtgc cagacatact gatgcttgat ccggaggggg 250081
aaggtgccgc cgatgagatc gcgatgccgg atcttggtgg cgtgcttgcc gttttagcgg

cagaggttga ggctgaaggc ggcggcgcgt atgagttctt cagtggcctg gatgagatga 250201
cggcaggaat gccggagggg gccaaagctg ggtttattca tcatcttatg agcctcgata 250261
atcccttttt ggaacgctgc gcgctgtatt ggctggtgtc tggtgcagca ttgacccggg 250321
aggccgtggc tgacggccta cgagaaaggc tcatgcgcgg ggagctgcag cctgaaactg 250381
catcctattt gccgattatt cgtggctggt tgccggcgag tgccgcccgg gcggctatcg 250441
atgacatcgg caagctgtct cggcgacaag gtcttgcaga tgcttccaat caaaacagag 250501
cggagccgat tgtcagcgac atcatggcga ccaccgctga cggtgttgga gcacaaggcc 250561
tgacgattgt cggaaaacta caagcccgga catttgtcgc gatgatcctg ttaaagaccg 250621
gatacggcat caaggatgcc tttgtcattc gttgccgttc aaagagcgaa gcaaccaaca 250681
tcgtctctta tgcccgccag gaagcaaaca gcgtcaaaat agatcgaatg actgccgaac 250741
tgctgctgga ggcggctctg gcggatggga tgaaaaacgg ccacccacca gcgccaggct 250801
tcattgacgt catagaggct tgcagcctga gccaattgcg gccccaggaa agggatctgc 250861
aggctttgct ggaacacgtc gatccgcaaa aggaaatcca gaatgcgaca gcggcagagc 250921
tgaatcggat gctccgcaat gcgtccgcac tggatgcgct cgtcccgttc accgacagct 250981
ggtttgaaga cacaggagaa acacgcggca tcatccaggg atctcgctca gtgcggactg

Figure 3 (Cont.)

251041
ttgaaaaaag gatctgggcc tttctcgaag gccggcgaga catttgggcg aggcgatttc 251101
tgcaaaccgc gatcattctc aaatcggcta agaaggagcg aatgtcaaaa gcactggcag 251161
ccgcagcctt cgccgtgatg cacaagcatc ctctacagga catcccgctt atgaaagata 251221
tcgctatgac cacactggac gcaggcggtg gatctccgtg gtgagtattt tgcgtatacc 251281
catcgtgaac ttcgccaatg aacagttcga ggctgtggat tcctatttat tttgggtccc 251341
gactgagata tcgaacaaat cgacgcgatg gcacacgcaa attgaacagt ttgcatggta 251401
taggacatgg ctcgtatcgg atatgcccgg acatttacaa cagaccagaa ccttgcggcg 251461
caaatcgccg cgctcaggaa cgccggctgc gaggtcatcc gcgaggagca gaaaagcggt 251521
gcatcgctcg aaggtcggcc gcaactgatg accattctcg acttcatcca tgccggcgaa 251581
acctttgtca tcacccgtat cgaccggctg gccagatctc tgcgcgatct tcaggtgatc 251641
gtcgaccggc tcaaggccaa gggcgcgcat ctggttgcca ctgagcaacc cgccgatacc 251701
tccacagccg ccgggaaggc gttcttcgac atgctcggcg tcttcgcggg gttcgaaacc 251761
aacctgcggc gcgagcggca ggctgagggt attgccgctg ccaggaaacg tggcatctac 251821
aaaggccgcc ccccgaagat tgaccgcgca gaaatcctgc ttcggctgca acagggccaa

Figure 3 (Cont.)

251881
ggccccagca agatcgctcg cgatctcggc atatcgcgcg gcacggtcta tcaggtgcgc 251941
aaaggtgttt tcgaatgagc aaggccatcc gcatcgcccg tttgacatcc gccacctgcg 252001
agcaaatcca ggcccgcatg cttgaggctt gcaggcagat cgcttcagat cacggcctgg 252061
tcatcgaaag cgccgggtgg cgcggcctgg agcctggctt ctcgttcgaa cctgcattcc 252121
gcatcagcat tcccgcgcca gatggcaagc ccctcaatct ggatagggag atgttcgccg 252181
tgttggccga acagtacggt ctggaggctg ctgacttcga acgcgagttt atcgctggcg 252241
gcgaacgctt ccggatcacc ggcattgatc cgcgccggcc gaaataccct atatccgtcg 252301
agcgtattcc cgatcacagg ggcttcaagt tcaccgctga caacgttgcc atgctgctca 252361
aagctcaggc caaaccctga cgttcaccaa tcgttcttca acttggccaa aatcacagct 252421
tcgagccgac ggggccaaat agcgggcgca tgtcgaaaga acgcatctcg aatcgaaaaa 252481
gtgacgggaa ttgcgccaga tcaaatgaag gttaaaagta cgaggttgat atgcgaagag 252541
ctggcgcaag gaggaacgcc atggcacatc atcgcaattg gcggtcccgg ttcgatgcag 252601
ttcttgttcg ggcgctaaaa aatgctgtta cgccgagcga tccggcgaag gcgacaccgc 252661
aagccaccgc gtcaggattt gatccacctc cggcggggag tgacccggga gtcccctatc

ttttgctcat gcggatggag gtgcttcagc tcgatcccac ccgagtcaaa gccttgatgc 252781
cagccgactt tcgcgtgctg gctcacgttt gtgactattg tcaaggtgcg agcgggatct 252841
tctctacttc gcagctggca aaccgactgt ctatccgttg agagcgatgg gtttacttca 252901
aacagttcgc cccgatcgac gcgtggcgac cgcctagggc cagcaactgg ttagcagggc 252961
ggtgcgccgg ccatgtgctc gcctccgccg aacgacctcg atagaagtgc cagtatgaag 253021
tctcactgga tcattgtgcc gtcatggtgg gccagaggtc ttagagaccg cagagaggcg 253081
cgccaaatga tccgagcgac ggcaatgtcg gcaatccacc gcagcagatg caagtgccac 253141
gctgcaccta caaggcacgc ccgccggtca tgagacgaag ccagcgacga aggttatcaa 253201
caaaaatcgg gcattgtttg gtgctctcta acggtacgca catcctgcgg gcgcgccctt 253261
catcgcctat ttggaaaact tccggatccc tcgaagaagc gacttgagtt ccggttcgtc 253321
tactgcgccg gctgcttcct ctggcgagaa ccaatgaagt tcgcgttgcc ccctctccgg 253381
atagtctcgt ttgagctccg agacatttag caagtgaact tggacgagag cgggcgctat 253441
tcctgatccc ttcagttttt tgacataggt gtagtatccg agaggtttcc ttttcacctg 253501
gccccgaact ccggcttctt cccaggcttc ttgtcgggca atctcgtggg gctttttcct 253561
gggcatactc cagcctttgg gaatgaccca gcggcgactg tctcggctgg tgatgagcag

Figure 3 (Cont.)

253621
aacctgaaca tcgttctctg ctcccggatt cggcctcaca caggcagcgg cgtattgagc 253681
catgacctta caccttcatc agcttggata aagcggaacg gttcgtactg tcagccggca 253741
tcactcagcc cgattccgat tagcatcccg tcgaggattg ggtgttcgaa ggagacgatg 253801
tgagcgttga tgcgcataag atcgcgcagc atgtcgagat gcaacgaact cgtctgaagg 253861
ctgtaggcgc gaccatcgca caagcgttcc agatgtggct cctaccattg tttctccctt 253921
tctgcgaacc tcgacgcggc gataaagaac gattgcggcg aggatcacca acggcgacag 253981
ccattcgact gccggtcgcg acaatccagg cagtgaccgc ggtcccggta ttggcgccga 254041
gcagcacaat ttcgccatgc gcggcttgac cagttcacgc tcgacgaaag atgcggccac 254101
caaggccgtt gccgttgatc tctgcagcac gactgtcacg accagccaaa tccgccgttg 254161
gtgccgttcg ggaacccagt ttggagcttc gctccaaaga ggctagacac gcctttcacc 254221
tgcgcaaggc tgaatagcgg caagggctac agcgccgaaa aaaaccagta cgagaatcgt 254281
aagttccatg tctccctcac actgaacaaa aagcgctcag cgcatttttg gactccagcc 254341
agacgcagca tcccagtggg cgagcgtcga tccgcgtccg ccgtcatgga tcccgcacct 254401
ccgaaaaggc tgcgacgttc gatctcgggg ggatagcttg gcagttcccg agaggatggt

Figure 3 (Cont.)

254461
ccgcgatgtt caagaaacgt gccaactgcc aggaaggagc tcggaagaac agttccgcta 254521
cagttcaacg gcttgcgctg gagagtgcgg cgtcgcgcgc ctggccgaac attgtgtcgc 254581
gcacttcaca ggaatagcga acgggtcgcc gtgttagcgg caacgcgcag atagtgcaaa 254641
tccagccgcc ggcaagggcc gctagcgcca ccaagatgca aatcgctccg atggattgcg 254701
gcgactacgc cccgcacgat acccgcctgt ccggccggtt gcatgccgat ggcaaagggc 254761
tcggcatgac gccttccgcg aaggaggcgt tggcggggcg ataggtgagg gcggccggat 254821
gtactgcata gtaggcgagt atgccgtgca ccgaaggcct cgcccagaag cgcacggcag 254881
ccgagcttgt aaatgccgag cttgtgggtc tggcaggctg ccacggacac ggtcaccgac 254941
atgagcgatt tgtggaaggt ggcggatggc cgcactcctg taatagcctc tgtcttagag 255001
tcatccggag gcgacaagcg tgtcgcagtt gcgacatttc agtgcccgcc gcgtctcgtc 255061
gggaaagatt ttagaaatag gccaggcggg agtggtggtt gattggccgt tacacgtatt 255121
tccaactgat ggcccggcca ctgccttgca aagtgcgtga cggcgcgact ccttgatcgg 255181
gcgccggcat caggcgtcgg gcgttgaagg cggccgggaa gcgcggtcat tgaggccagc 255241
ttcgtccagc ctgtctgtac ttcaacgtga gccaaatctc agcttccagc cgaaagcctc

cgtgcgacac attgccctct ccgcgcgata aagcgtttct tcctgactac ggttgatctc 255361
gatcaatatg ccgccgctgc gcacagtcta ccgttcgcct tgcaacgatt ggttccgatc 255421
caacttatgc tggttcaagg agaggtcaga tgagcaggaa tgatgcacgg tatctgagat 255481
gtaccgcggc actgggtgcg gctttcttcg catgcggggc agccgcggcg gagctgacat 255541
caccgcctgt tgccccggcg acagagggtg tagcggccgg gctaagtccc tggcagatcc 255601
gcgtgcgcgg tctgggcgtc ctcactgagg acagtggctc aatcaacggc gtgcctggct 255661
cggacctttc ctattcggac tcgttgatcc cggaactcga catcagctac ttcttcaccg 255721
acaatatcgc cgctgaactt atccttggca cgacctatgc caacatcaag gaagttggcg 255781
cggtcggggt tccggtcggg aaggcctggc tgctgccacc gacgcttacg ctgcagtacc 255841
atttcaccga cttcggcgcc ttcaagccct atctcggcgc ggggatcaac tactcgctgt 255901
tctacaacca gagcgaaaag gcggggttcc atgacctcga cgtcgacaat catgtgggcg 255961
ctgcgctgca ggtcggtttc gactacatgg tcgacgagca ttggggcgtg aacttcgatg 256021
tgaagaaaat cttcctcgaa accgaatgga aggctgatca tgacgttctc ggccccctga 256081
gcggcaaggc aaaaatcgat ccgtggttga tcggcgcagg cgtgacctac cgtttctaat 256141
agaccattac tgccggagag ggagacgcag gcaccacccg tcgggcgcgt ccccaattgt

Figure 3 (Cont.)

256201
aaacggtctc tatgcagacc ctgaaggcgg gtcacgtcgc cctctgttcc ctggaaaatc 256261
cagagtgaca ggtgcaaaag atcgccgact ccgtgcaatg tccgcggcgc ttccgtcgcc 256321
tccggatgta ctctcgataa ccggtggact ttcgtcccgc tgatgatccg ttaaaagaca 256381
ccgtttcgcc ggaaccgtac gtcagtcaac gatacccgac tttgaaacgc attcatctac 256441
gcagtggatc tttgctatcc acacaaccgt tttggcaatc ttccgaacgc cggtatagag 256501
agttgacttc aactggaggc aagggcgaat gtctattgcg agccgctgtt agaggtggtc 256561
tgattgtcga actcactttc aggccatcgg tctatgacga tccgccgaac cactgcgaat 256621
ttgccctttt gtaggccaag gatgtgatgc gcgggaattc cgatcatcga gatcgatccg 256681
aagcgcgcgg ccgcaggcgg cgcaatcgcg catgtcgctg ctttgcgcga cgaacggctg 256741
gcttgcctgc aaaagctcag aaaaaaaggc cacgaagttc gtaagtctgc agtaaaggag 256801
tttcatttcc atggtttttt cattttccac gttcaatcgg ctcgtcacct tcaccgtcat 256861
ggccgccatc gtcagcgtgc ggcctttgac ggcggaagac ctgtcctccc agcagcagtg 256921
gccgggaacc cccttgtcac gagtggaagc ccttgcggtt cttcagactc taaacgcgaa 256981
tctcctcagc aatgccagtg cgacgctcac gctcgatcgc tggtgtgaag cgcatagact

Figure 3 (Cont.)

257041
tgcaccaccc ggttcgaaga tcgtagcaaa acatgtacag ggacacgaca agccagctaa 257101
cgttcatatt cgtaaattgc tgcacgtcgg gcctaacgag ccgatcgtct atcgccatgt 257161
ccgcctagca tgcggtgatc gcatcctttc ggaagcagac aactggtatg tacccgcaag 257221
attgacagcg gagatgaacg aggtgctgaa tacgactgat atctcgtttg gtcgagccgt 257281
tcgatccttg aacttcaccc gaaccaacct aacggccaga ctgctttggt cccctcttcc 257341
ggaaggctgg gacatgtcag ccgaattacc agtgtcgagc tcagggccct tgattccacc 257401
gccattcctt ctcgaacatc atgcggtgct aaagttgcaa gatggcacgc cttttagtgc 257461
cgtggtcgaa agctatacga acaatgtgct cgattttccg gctccgctgc tatatccgca 257521
ataaagccta gtggattggc tggcgactcg gcgttagcac ggaatccgat tgaagccgga 257581
cgccattcgg atcggacacc ggacaggatt cggattgtgc cgagcagttt ggagtgatga 257641
ggcctccgcc accggcgtct taatcgttga gccgatcgga aggtgcgtga atcagcgctc 257701
gcttgcaagt ttcccacgcc tgctcagcga atagtcaagc gtgtccacgc tgcgctcctg 257761
cccagtcctg acatttcgat ctctgcctac tgaacatcaa tgaaaccacc tttgcccccg 257821
ctatcgactt cgcgaccgaa cgctggagcg ccgacggggt ctttgaggca agcggcagcg

cgaatggctt cgaggggctc ctcgatctgg tgcggccggg cgcgtgccgt ggtcctggtg 257941
ggcctgccgg tcgatgtagt gcgtttcgaa ttgccgggcg tgatcaccag gaaggtacgc 258001
atcgagaccg tattccgtta agccaaatct tcgacgccgt ggatcgccgg gcgcccccct 258061
gaagtcaccc cgcatggccc agatgcggaa caattatgat tgcggcgtgt tcgtggtgga 258121
cggcacgcgt gcgctggtta gcatattggc gcaaggacca cgaccagcgc acgagccgct 258181
gcacctcgac aacctcgtcg ccgatcggca ggcacttcag gaccgactga gggctcatct 258241
tggaccgata gaatttgggg agcggcttga gcggctgtcc tgcggccatg gcgcccagcg 258301
caatttcggc gggacgcaac agcccgcacc acatgaccct gttgcgggag gactcccacc 258361
gttgatcccg ttttgagtat ggcgcaagga ggcggtcggc ccagatcggt gggccgccgc 258421
atgatgttag ggagccttgg ccgcattctg acgacgatgc agctcttgcc ggcgcacttg 258481
ttggtcagcg cgctcctgtc aagctgcgcg aggcggcgta gtcacgccgc tgctggcatt 258541
aaacgcttct gcgaaaacga agacgttcct tcatcaccga acactcttct ccacggcatc 258601
aacacctccg gccaacaagt gttactcctt gtgtccggta cgacacgtcg cctatgttct 258661
tgcagcatct ccgcgtcgaa gcctgactta tcggcgagcg tcggacgcgg ggggagaaga 258721
aatactatgt tgctcaccta cccgccaagg cagacctgcg cacgttagct gccacaatca

Figure 3 (Cont.)

258781
agtcctgacg gagttgctaa caggcccatc agcagctcaa agaggaattc ggacttgatc 258841
aacttcgaac cgcgatcctg gcaatggcac ggccctcatc gtcacgcatt catgattata 258901
gttgatttac cttccttcaa catcggcgtc ttgcagcgga aaaaagacca ctgagccgcg 258961
gcatcccgat ctcgcctccg gaaagccatg gcctattctt gtgcccgatc cagacgtgga 259021
agacagcggc taaatcgaca acctgacgag tttggcgcgc cctgcaaccg agtccgcaaa 259081
gtgatttatc ctagctgaat cgatgtagag gtctgaggtg tcttccaata ctctcgctac 259141
ggcttcagcg gtggagtcga ccaagtttgt aattcggcgg cgcaccaaag gtaagccaac 259201
tccagcttcc tttgcaaaag tctgccaccc atcagcgtcc atctcggcaa gcgtgacccg 259261
tttcccgatc ctcatggcca ttttcggtga aaggtctgga taggcgaccg tagaaagcag 259321
atcgtacagc ggggccattt tcggtccctg atcgtcgtag aggatcgaga aattcttgcc 259381
gtgggcatcg gcatttccga caaccaggtt gaagatcgcg gcgtccagca gcttcaacac 259441
atctgtagcg ggccgcgctg atactcgccg caacagctca aagcagtcct tgaatgtcgg 259501
cccgccctcg ctggcgtatt tcgtttcagg cggcacacca agtgcttggc aaaagtcttc 259561
ctggtggatg cggtgaacca caccgtcggc atcgcgatag cgatcgtatc gctcgaccac

Figure 3 (Cont.)

259621
aagaaaaggg cgcccattcg cagacctcgg ttcgactggt gcaacgtcga ggccgatcgc 259681
tgcagcgagt ctcatcacga atgcttcgtt ttcggttgtc cctggaaagc gcgcgattgg 259741
tggtttcaga atatgtgttg ttgcttgtcc ggaaactgga agcgcgagct cgccgtcaat 259801
caaaacaagc ggcaccttgg actgcgcgcc ggctagcgat agcctcaagc cttcctggcc 259861
ggccaatagc ggccgcgtcg gaagtgcgtc cagtatccga acgattccgg cctcatccag 259921
aggtgtcggc tgctggtctg gaagcggccc tgcctctatg ggctcctgat cttccggcaa 259981
aagctgaagt gcgccggcga cgtcgccgcc caagcgatca aggagcgcaa agtcgttcgc 260041
aggtgaaacg cccaatgcct gcgctgtcac aagacgctgg ctttcctcgg gcaacaggcc 260101
gccgaaaaat ggtcggcatt cacgacgaga aaaaggttct gcgcgcttcg ggagggaggc 260161
agacagcgga agcgtgtttt cgtcgtcgag ccaagcttcg ctgtaggcaa agccgatatc 260221
accgtgcctg tcctgggtga attgcccgac aatgcgacca tcccaccaga cgttgagaac 260281
ccttaccgtc attttctacg ttcaccagga gccagaatat cgatcgaaca gccgagtgtt 260341
tgcaaaacct gcaacacttt tcctatctga gctgtcggtt tgcccgcttc gagatcgaca 260401
atgaaccgga ggccaacgcc ggcaacgccc gcaagctcat cctgccgcaa gttttgctcc

ttgcgcacga tgcggactag agcgccgata tcggctggag ttttgatgcg cttcgccatt 260521
tttttgtttt cccgctcggg aaagtagcat catatcggcc gccctgtcga gtgaaatttc 260581
ccggtcggga aaatttatgc ccgagaaggc gtatcgccaa tgaaatttac cgctcgggat 260641
tacgaaattg agtggcaatt ttggtggcag gctgagtttt cgtcccgtcc tcaaattcta 260701
tgaagcgcag tataagcctg ggcggcgtgc gggctcagat tccgccgcgc cgtttctgcc 260761
tggactgcct cccttatctt taggccgctg aggggcggcg cctcacgtgc ggcctcatcg 260821
acgacggtag cctttctcgc gcccgcaagt gcagctcaaa ggcggcttgc gcctggccag 260881
cttgctgatc gtcggggagg gcatgctgaa cctgcatcga agcgccagtt tggttggcga 260941
aaaattgtcc atgctagtct catctccgca gatcccggcg gcacgctacg ctggcaagct 261001
gccgagaagc tgacgagcct cgccgcgcag tgtaaaaaag ccgcgtgcca atcccatcgc 261061
ggacacgaaa aaagtcctgg acgcaagcgt gccgctgaat atgcgcatca agcctgcggt 261121
ccgcaacctg agcccgcgct gccgagctgc ttgggaagac acgcactaat ttcatgccgg 261181
aggtctctga gcgtcgcgcc gaggaggcgc tgctcgtcgc gcacttcgtt gcctgcgagg 261241
gcaaccgcgt catcgcctac tgcgcactcg cttccggtgc ggtaaagcag ccgaagcggc 261301
tggcggtttc cggcgcaata tgcctgaccc ggttccgggt gccgtcctcg gccgcctcgc

Figure 3 (Cont.)

261361
agtcgaccct cctattaggg tcgcggcatc cgtagggcat tggtgcacga cgcaggcctg 261421
cgcctgctcc atgcttttga aatcctcggc attcgcggtg tgctgttgca tgcgatttcc 261481
agtgagcgcg agcgttctag aggcgatcgg cttcctgcct tcgccgtccg atcccacgat 261541
gctgacggcc gggttgcatg atctcagcag tgcgctgaat ccctgacgat ctttaggccg 261601
ccctcacaat tcggatgtgg ttttgtaatc gtcattagaa tgtggcgagc actgtagcgg 261661
tctacccctt tgccgaatca acgctgtcgc cgggcacggg cgaagcctgt agcaccgctg 261721
cggaagcgta agcctcagtc cccgcgttat actcggtaaa atgtggccgc gttgtcgtgg 261781
aacagtgccg agcgttctga gaccgagaag cccacggtga tcttcttgaa ggcattccaa 261841
atggcgtcgt aacttgagaa cagcttatcg acggggaaat tcgaggcgaa catcgccctg 261901
tcgaccccga aggcggcaat cgcctcctcg acatatgggc ggatgctctc gctggtccag 261961
ttccagttcc ccataccgag gccagagatc ttgcaggcga cgttgggcgc ttgtgcgagt 262021
gtcttcatcg ctttccgcca gccctcaaaa tgcgacggcc cgtcaacctg catgccggta 262081
tggttgagga tgatctgcac gtctgggaaa tcacgggcga gttcaaggaa ttcctccatc 262141
tgccagtagt agagctggag gtcgtaactc aggccgcgac gagccagctc cttgaagccc

Figure 3 (Cont.)

262201
tgccgccatt cgggcgtcct gctgacctcg ggctcattca ggtaggtctt ggcgccatcg 262261
gtgtgaaagt tcatcgactg gcggataccg cggaagttcg cgtattgcat atgctcatca 262321
agcaggtcgc cgacatcggg cttgcggaag tccgcatagc cgacaatgcc gtgagggaag 262381
ccatgcttgt ccgcaacgcc ttggagccat ttcgtttcgc cggcggggtt cgtggggtca 262441
aatccgacat cgagatggac cgccttgacg aggttctggt tcttcgcgtc cgcgaggaaa 262501
tcctcgatca ggtaggtctt gttgatagct gtataatcgc cgaaggctga aggcttaaca 262561
ccgtcggaaa gccaggggta gtagttggtc tccaaatccc agaggtggaa atgggggtcg 262621
atgatggcga tgtcggacat ggtatctcct cggggtcgcg ggaaacggca ggcaccgccg 262681
ttcccgcgag tctcctgtca gttgctcggg gggaaaacgc gggcgatgac cgccttcgct 262741
tccgccgtat cgatcttgtc ggcggtcacg agcggcatga caagcgcaag atccttttcg 262801
accggagcat tggtcagagc gttgaatacc tgcagcgtgc cgtcgatgcc ctgtcccacc 262861
gcctcctgga agaagatccc ctggatggcg gtggctttca acagtgcaat ggtcgtcggg 262921
ctgccgtctg cgaccgcgat gccgatcttt ccggtcaggc cgcgggtttc aagcaccttc 262981
gccgctccgg tcccggcctc atcatacata ccgtagatcg ccttgatgtc cggatgggcc

gtcagcatgt cattggcctg cgtcaccgcc tcattgacgg tcagcccacg cgtctccagc 263101
atctggacaa gttcgcagcc gtcggctgcg aaggcctcct gagcgccctt gagatacttc 263161
tgggcgttct cgcggtcctg cggaagggaa agcataccaa ccttgttgcc gccgcgctcc 263221
ttggcgaggg cgcagacgaa gctgccttgg gctttgccag tttcgtagtt gttggcggtg 263281
accgaggacg tgtagtccgt ctggccgggc tgcgggccga tacccgcgaa agcgatcggt 263341
atgttctggg atttcagata ggcgagcaga ggcggggtgc tggtcgagct caccggaccg 263401
atgacgatcg cgtcgacgcc ctttgtcacc gcggtccgcg cattatccat ctgcttggcc 263461
ggcgaattct cggaggtgaa ctcgacatag tccataccta gctcttgggc cttctgcttc 263521
acgccgaagc cgacccactg ccaataggaa atgtcgagcg atggcgcgag ataggcgacc 263581
gttttcctgt cctccgcatg cgagacgctc gacaacgctg ccagcgctgc acccgctgcc 263641
atggcgagcc acccgttcag tttcttcctc atgccttctt cctcctcttg acgtccaggt 263701
ctcccccggg acggattaca cggcaccgcg ccgcgatttg ctgaagcgat cgatcaggac 263761
cgcgatcagg atggcgaggc cggtgaccga tccctgccag aaactattga tgccgatgag 263821
attgacgccg ttctggatga ccgtgatcat gagcgctccg agaaccgcgc ccaccgccgt 263881
tcccgtgccg ccaagcaggc ttgcgccgcc gatcacaacc gcggcgatcg cctgcagcat

Figure 3 (Cont.)

263941
gaggctcgaa ccggccgtcg attccgcatt gagaatgtag gaaatcgtca gcaatccgga 264001
gaaggatgcg agaagtgacg aggcaacata agcgaagaac tgcgtccgct tgacgggaat 264061
tcccagaaga cgtgccgctg ccgcgctgct gcccacggca tagaaccagc gccccgcgac 264121
catcttcttg agaaagatct cgatcacgac gagcaggacg atgcagaaca ggatgtagtt 264181
gggcacgccg ggtatcaggc tgccgctgtt gagcagccag aaatccggat cgccgatcgg 264241
catcgagcgt ccattggtga cgatgaaagc gagtgagccg gccacggcaa aggtgatcag 264301
cgtgacgacg aaaggcgcga gaccggccac cgtgacgaga aagccgttga tcgaaccgaa 264361
cacaagcccg accccaagcc caatcagcgc ggcgctgacg tcgagacctg aggccatagc 264421
ctgtgctgtg accatgccgg tcagtgagaa gaccgagccg acagaaaggt ctatgccgcc 264481
ggtaatgacg acgagaagca cgccgagcga catgatgatc agcggtgctc cggcctgtgt 264541
aatattggcg aaattgcccc agctcatcgc ctgcggcacc tgtgttccaa ccgcgagaac 264601
gagaaggaca atggcccctg caatcgccaa ttccgtacgg taggcggaaa cgaggccttc 264661
ccgagttcgg attgcccctg gcgtagcccc ggcctggtca ataatggtct tcgtcatgcc 264721
gccattcctg tcaatgtcgc aagcttgtct tcgctgagtt cgtcccgctc gatcacaccc

Figure 3 (Cont.)

264781
gatgagcgcc cctctgtatc gaaagcgagc acctggtcgc agatctcaag caattccgcg 264841
ttttcggtcg accaccagac gattgccgtc cccgtagtcg ccatgtcccg gatcaactgg 264901
tagatttccc gcttggtgcc gatatcgacg ccgcgggtgg gttcttcgag caccaggagg 264961
cgggaaggaa cgttcagcca gcgggcgaga agaagcttct gctgcgtgcc gccgctcagc 265021
gtgttcggca ggtgccagag cgaaccggct ttcactttga gcgcctgcat caggtccaga 265081
cactcgacct cttcccgctt ggtggcaaac agggaaccgc gcgtcgcgcg gcgcgatgcg 265141
agcacattgt cgatgatcgg cagggaatgg aggatgccgc ggtgcgaccg gtccccggtt 265201
acgaagcctg ctccgaggcg cgcggcctct cgcggcgaac ggaaacggtc gggccatccg 265261
gcgcgcgtta ccgtccagcg cctttcgtgc gcggcgccaa tgagcgcggc gatcagggtt 265321
tcggggcccg caggagcgcc ggcaacaccg agaatggtcc caggctggag cgttacggaa 265381
aaccctgttt ccgcgatcgt cagcggttca tcggacagag acgccaccgg tgccggccga 265441
gcggaatggg caacggctgt ggcttgcgcc tgccccatat gctcgatgat ggcgagatcc 265501
gacagctctg ccgtcggcac gttccccacc acggttcttc cgtcccggat aatcgagcaa 265561
acatgggcga tctggcggat ttccttcatg cgatgcgaga caaagacgac cgagaggcca

tttccccgtg tcaattttct cagaaccccg aacagccgct ccgtctcggc cgcggtcaga 265681
ttggcggtcg gctcgtccag gaggataagt tcggcccccg acgacagcgc tcgcgcaatc 265741
tccaccatct gtccctcatg gaggctgagg tcgccgacga gacggttcag cgcggtaccc 265801
gcaaagtccc gatcaatcat cgaaagggcg gcataggcct ggctgccggc cgtccttcca 265861
tcgtaaacgc gcgagccctt gcggaaatga ggcagtgcta tgctctcagc aaccgtcagg 265921
tggggaagaa gcgcgagttc ctggtggacg acggcaacct tgcggcgacc gtccgcttcg 265981
gtgaggatgt tgccggccat atcccggaag acgagttcgc caccatcctt tgccgccgtt 266041
cccgtgatga cgcggatgag cgtcgatttg ccggcaccgt tgccgccgag gagcgcgtgt 266101
atttcgccgc gcgctaccga aaaatccacg cctttgagca cgactgtcgc accatacgac 266161
ttggtaagtg atcggaccga gacgatgtct ttgctggcgt cggtcatagt cctgtcctca 266221
gtagagcgtg agcgccggga tgaagctcac cgcaagaagg agcgtcatcg ccatggcaaa 266281
gaagggccag agttcacggg tggtctcgcc gagtggtgat ttggcgatcg acgaggagat 266341
gaagagcgtc gtgccgatcg ggggggtgta gagcccgatt ccaagattga tcaccatcat 266401
cagcccaagc tggacccggt ccagaccgat cgtgtcggca aggggaacga agatgggtcc 266461
gagcagcagg atggcgggcg gcatatcgag cggcatgccg acgatcagca tcaggatgtt

Figure 3 (Cont.)

266521
catcattagg atgatgacga tcgggctcga gatgttggcg gcgacccaat ccgccatctg 266581
ctgcggcgcc tggtcgaagg tcaagaccca acccacggcg gcactgccca tgatgaccag 266641
catgaccacg ccggtggcca tgccggcctc gaccacgttg tcgcagaatc gcttccatgt 266701
caggtcgcgg tagtaaagaa ggctgagtgc gagcgaatag acgaccgaga gcaccgcgac 266761
ttccgtgggc gtggccaggc caaaccgcag gaataggatg atcagcaccg gcagcagcac 266821
cgcgggcagg ctcttcagtg ccagcgtggc gagctgccgc ctgctggtct gcgagggctg 266881
cgaggcgtag ccgcgcctca ccgaaacgaa ccagcagacg aagacaaagc tcgcggccat 266941
caggatgccc ggcaagatgc ccgcgacgaa gaggttggcg acactgacgc cgcttaccag 267001
ggagaagagg atcatgggaa tcgacggcgg tatcagaacg tcgatgaccg ccgaggtcgc 267061
gttgttggcc gcgcagagcg cgggcggaaa gccgtgcttt ttctgccacg ggataagaac 267121
ggatccgagg gcgctggcat tcgccacggc ggaaccggag acgccgccaa acacgacgga 267181
agaaacgacg gtggtcgaca ggggtccgcc ccgccagcgc tgcatcgcat gcgatgccag 267241
ctccagcagc tgccggccga gctcaccgcc aagcatcagc gtgccggcca gcatgaagaa 267301
cggcagcgcg agcatcggaa aggattgggt ctggtcataa atctgctgcg ccacaatcga

Figure 3 (Cont.)

267361
aagcggcaga tagccgttga acaggaccgc gacgccggcg gcgataatca gggcgtaacc 267421
gaccggcact gccagcatca tcagtgcgca gaagacaatg atcatcacga tcgtcatagc 267481
gccacctcgc cgctttcggt attcgtccgg tggtcccaac cgaggcgcag cacgcgcaga 267541
gcgacagcga gcgtgacgat cgcgaccagc acggatccta cggcaagggc gaaatacccg 267601
acgctgttgg gcaattggag gaccgggctg tgttcgatcc cggcgatctc gccaacaaga 267661
taggcctggt agccgagcat caggaaagct ccggcgctga cgagattggc ggcgacaaat 267721
gcagttgaac gtgcgccatc ccggagtttg tcgtagatcc actcgaccgc catatggccg 267781
ccggaatggg ccgccagcac gatgccgccg aggatgaacc agggaaagat cagcaccggt 267841
agctcctgag cgaatgaaaa gcctccgccg gccagcacgt agcgggcagc gacattcgcg 267901
gtcatgaaga ccatgagtgc gatgccgctg aatatgacga cctgccgcgc gaaccagacg 267961
atggcccgtg ccgtcagctc aacgagattt gagaggcttt tcatgggatg ctcccgcgcc 268021
gacaaggcct cagcctttgg ctgccgattc gatctgggcg acgaaattcc cgaagggctt 268081
cttctgctct cgacaacaga agcagtcgcc ttggcgaagc cttcgcggtc cacctcggtg 268141
acctcgatcg cggaaatgcg cctgaaggct gccaacactt ctgcgtcctt gtcggcggaa

agcttgcgct gcagttcgcc ggcttccttg gccgccgcct tcactgcctc gagatcgccg 268261
cctagacggg cttgtgcaat ctgcgacatc aggaacggcg tcgattccca tttatggccg 268321
gtgagactga tgtacttgtt tacctcgtag agcttggagc tatcgatatt ggcgagcggg 268381
ttctcctgtc cgtcgaccac gccctgctgc aaagccacgt agagctcgcc gaaggcaatc 268441
tgctccgtcg ccgcaccgag agcctgaaaa atatccatgg tcatcgggtc ggcgggcgtg 268501
cggatcttca ttccgctcac ctcggcgggg gctgcgacct tgcgcttcga attggtgagg 268561
tggcgaatgc cattatccca ccagtcgagc ggcaccacgc cgaccgcttc gaagcgcttg 268621
acgagttcgg cgccaacggg cccaccgaga acctgcatcg ccttcgccgt gttctcgaac 268681
aggaacggaa gaccgagcgc ggcaagctcc ggaacgagcg cggacgtcgc tccctggctg 268741
ttggctgtga catcgagcgc gccggtgcgc aggctcgtca gcatcgcggc gtcgctgccg 268801
agtgtttccg cgccggccac attgatggtc acacgaccgg ctgtcttctc ggctaccagt 268861
tcggcaaact tcgcggccgc gacagttcgc ggatttcccg gtgcggcacc atggcctagg 268921
gtcagtgtcg tgccggcccg tgcgggccga accatcgtga cgatcgcagg ggccgcgagc 268981
acggccgatg acgcggccag gaagcggcgt ctggttatct cgtacttcat tgtctctcct 269041
ccactttgaa actgttgcgg ccccgatgct cctccagcgc gggtgaccgt tttcgtcact

Figure 3 (Cont.)

269101
cgtcgagcca ctccttgatc tgggccacga ttttcgtggt cgatatgccg tacatgtcgt 269161
gcagggtcgg cagggcgccc gcttctagaa aggcgtcggg cagtccgatc tgccggaatg 269221
cggcgggacg cacagcggac cgcatcaagg tggcggcgac cgcttcgccg aggccaccga 269281
taacggtgtg gttctcagcc acgaccacaa gccgtccctg cctggcgcac tcagcgagga 269341
tcgttgcctc gtcaagcggc ttgatcgtcg gaacatgaag aacgccggca tcaatgccgt 269401
tcttgcgaag ttcctcggcc gcttcgagcg cccgcatcgt catcagaccg gaggaaatta 269461
tcagtgtgtc cctgccatcc cgcagcagct tggccttgcc cagttcgaac cggtagccgt 269521
attcctcaag cacgagtgga acattgccgc gcagaagccg catatagacc ggaccctcgt 269581
gggcagcgat ggccgggacc gcctgctcga tctcgctggc atcgcaagga tcgatgatgg 269641
tgaggttcgg catgccgcgg aacatggcaa tgtcctcggt cgcctgatgg ctcgggccat 269701
agcctgtggt cagtcccggc agcgcgcaga cgaccttgac gtcaagcatc tcctcggcga 269761
tcgcgaggca gatgaagtca taggcgcggc gcgatgcgaa gacggcatag gtcgtcaccc 269821
agggctgcag cccttcccgt gccatcccgg cagccgacat catcagcaac tgctcggcca 269881
tgcccatctg gtagaagcga tcgggatggg ccgcccggaa gacatgcaga tccgtgtatt

Figure 3 (Cont.)

269941
tggcgagatc ggccgaaaga ccgacgacac ggtcgtcctt ttccgccaag gcggaaagcg 270001
catgtccgaa aggcgccgga cgtgtcggct ggtcggcgcc ggcaatggaa gcgatcatcg 270061
ccgacgtggt taatcggggt ctctccgcat tgccgatcag atgggcgggg cgttcgtatt 270121
tcgagcgtct catgccgtca ctcccgcgtc gatgatccgg atcgcctcgg cccattcctg 270181
cggttcgacg cgcaggaagt ggttgcgctc acgcgcctcc aggaagggca cgcccttggc 270241
catcttcgta tcgcagatga tgattctggg ctgcggatgc cggtgctggc gcgcattgtc 270301
gaaagcgtcg acgagcgcat cgatgtcgtt gccgtcgatg cgttggacgt accagccgaa 270361
ggcctcgaac tttggaccga gaggctcgaa gttgagcacc ccgagcgacg ggccgtccgc 270421
ctgcatctga ttgacgtcga cgatgccgat caggttgtcg agcttgtagg aaccggccga 270481
catggccgct tcccaggtag aaccctcgtc gagctcaccg tcggagaaga ggttgtagac 270541
gaaggaccgc gaacctttgc gcttcagcgc gagcgacatg ccgacggcta tgccgaggcc 270601
gtgacccagc gatcctccgg taatctccat gcccggcgtg taggccgcca tgccggacat 270661
cggcaggcgg ctgtcatcgg cgccataggt ttccagttca tcttcgggaa tgatcttcgc 270721
ctcgatcaag gccgcataga gtgcgatggc ataatggccg atcgacaata ggaaacggtc

```
         gcgaccttcc cactccggat cgtccggccg gtaggtcgtc gcatggaaat aggcgaccgc

270841
         gagaacgtct gcgatgccga gcgcctgtgc gatatagccc tggccctgaa cttcgcccat

270901
         gcggagcgca tgccggcgaa tgcggcgcgc acgctcgggc agactgatgt tgtgaccgat

270961
         ctgagccatg ccgtccttcc tttcaggctt cctcgtggat caatggatca gcatgccgcc

271021
         attgacgtcg atgacggcgc ccgtgacgta ggcggagaga tcggatgcga ggaagagata

271081
         gatgttggcc acgtcgcgcg cgtcgcccaa acgactgagc ggaatgccct tgacgatgtc

271141
         tgcgcgcatc tcggcggaca gcttgtcgcc ggtgatgtcg gtctgaatga gccccggtgt

271201
         cacgcaattg acgcgaatgc tgtcggggcc gaactccctg gccatggcct tggcaaggcc

271261
         gagcacgccg gccttggccg ccgaataatg ggggccgccg aagattccgc cgccgcgctg

271321
         cgctgaaacc gacgacatgc aggcgatcga tccaccgcca ttctgccgca tgtttggtat

271381
         gaaaacctga ctgagattga gcacgcccgt catgttgacg gcgacgatgc gctgccagtc

271441
         ggcgtcagag atatcgaggg tcttcaccgg ctgggtgatg ccggcattgt tgatgaggat

271501
         gttggcgacg ccaaacgcgc tcaagacctc atccgaggcg gacgtgcagg aggcacgatc

271561
         ggcaacgtcg caacgcagcc cgatatgcgc accgtgttcg accggcggca ggtcgcccgc

271621
         tgcagccttt gcctcatcgg cgttgatgtc aagaatggcg acccgcgcgc cgtgcgatgc
```

Figure 3 (Cont.)

271681
aaaaagctcc gccgttgccc ggccaatgcc acgcttgctc gccgcgccag agatgacggc 271741
ggtctttccc ttcaaaagca tcttttcttt cctcccgaca ccgactatgc ggcgcctggt 271801
gtctccttcc aggcctctgc ctgtcctcgt ggaagagttg tggcgtagcg cgcaccgtcc 271861
ttcaaacgcc aactttacat ctgtgggtga atctgattca ctaatcccat gctgcagacg 271921
acgtcactct ccgctatgcg catttttgaa gctgccgcgc gactcggttc gttccgggca 271981
gccgcggagg agttgaacct ctcgccgagt gccgtcagtc atgcgattat gcggctggaa 272041
cgggatctgg gggtggcgtt gttcgaacgg acgacgcgca gcgtttcgct gactgtcgcg 272101
gggcagacac tactcaatca tgcgtccaat gccttcgaag aattgcggcg cggtgttgaa 272161
caaatttcat ccaacaaggc gcaattgctg cgactccact gcgcgccgag cttcgcggca 272221
caggtgctgt cgccccgtct gccgcagttt ttgaaagaga atcccggcat agaggtccgg 272281
gtggcggcca gcaccaacta cgcccgcttc gtcgatgggc tcttcgatgc cgatatcgtc 272341
tacggcgagc cactcaatcg tgaagacctg atcgtcatcc cgctttctga agaaatcgtc 272401
ttgccgcttt gcgcgccgga tctggcgcac caaatcaagt ccccgcgcga cctgtttcac 272461
caaccgctga tccgaagcga tctcaagcgc atccagtgga tcgactggtt cgaagccaat

Figure 3 (Cont.)

272521
gaccttggac caccaccatc accatcgatg agttttgacc ggagcttcct tgccgtcgat 272581
gctgcggtca acgggctcgg aattgcgctc gagtccgatg tgttggccag gcgcgagctg 272641
gaaagcggca agttggtccg tcctcttcat cggatctgtc gcgacaaccg ctatatcggc 272701
cactatctcg cctatccaaa atccggcagc cagcggcgac tcgcccgcgc ctttgccgat 272761
tggctgacgc gcgaatgcca gccggccagc actggctcag agtagacatt ccgccaggct 272821
tctcggccgc gacgtctcac tcgtttccga gtgaagcgga cgagaaatct ttcaaggccg 272881
gtcgctcaac cgtatcactg aaggggccgc gtacccgagg cgtgattggg actaataacc 272941
gtcattgcca gataggaagc atgtgagcag gtcgatccgg ggaaactcga ctgatcaaag 273001
aacgggtttc gctcattccc agattcgaaa ccacgccggc ggcaatggca gggaccaggg 273061
tattaagggt tgatttttgg cgggctgcat ggaggtacat cggtggggcg agaagaaagg 273121
cgaaacttcg cctccttcgt cggttctcgc cactgggttc attttgctca gatttgcccg 273181
acatggccta aggctttacg cactcactta ttatccatga gtttttgaaa catgtagatg 273241
tattcgaggg cgtagcggcg ggcgtgttcc tgcaggttgg cggcggcggc gtgaccgccc 273301
tcgatatttt cataatagta gaagggcagg cccatgtctt cgaacagcgc ggccatcttg

cgcgcgtgca ctgggccgac gcggtcatcc tttgtcgaag tttcaaagaa gggttccgga 273421
tacgctacgc ccgccttgac gttgtgataa ggcgagatcg agcgcaggaa ggcgccttca 273481
accggatcgt cgggactgcc atattcggct tgccaggagg ctcctgccga catgcgggtg 273541
aaattgacca tgtcgagaag cggcacctgg atcacgactg cgttccacag gtcggggcgc 273601
tggatcattt gcacgcccat gagcaggccg ccgttcgaac cccccatgat cccgagatgc 273661
ggtgtcgagg tgaccttctt ggcgatcagg tcctgcgcaa cggcctggaa gtcgtcatag 273721
acgcgctgac gatttgtctt caaaccggcg tcgtgccatt tcgggccgaa ttcgccgccg 273781
ccgcggatat tcgcgagcgc gtaggcacca cccttttcca gccacagttt gccgagcacc 273841
gccgaatagc tgggctgcat tggaatttgg aaaccgccat aggcatagag gatggtcggg 273901
ttcgtgccgt ccagcttgac gtccttgcgc gctacgagga agtatggaac cttcgttcca 273961
tccttcgagg tcgcccagaa ctgctgtgct tgcaggcctc cggcatcgaa gcgtgctggg 274021
gtcgaagtga tcttctcgac ttggccggtt gcagcatcgg cgcaaaacag agttgagggt 274081
tcgaggaacc cttctgagaa gacgaacaac tgatcgctct catcgtcgct agacgtcagg 274141
gacagcgtcg aattttccgg cagagccagc ttgaaagacg accagccgcc cttgccgaaa 274201
tcgaagctgc gcacctcgct ggtgacattc gataggatcg acagcacgag acgatttttg

Figure 3 (Cont.)

274261
gtctgggtag tgcctgcgac agattgatgc tcgtttggca tgaacagcac aagcggttca 274321
acgcgcgctg gatcggcgag cgccgccttg agatcgaaag cgataatcgc accattgtgg 274381
aagacggtgc ctttggccga ggtccagtcc gacttcaacc aatagattgc ctggcccttg 274441
tagtagccgc taaagacggc cgtggtcggt aggggcagga ccaccttgcg cgtatcgggg 274501
tggccgtttg ggtaaaaggc tagttcggta ttgaagaagt cgaggccgcg atacgaggtg 274561
tccataacat acttgccatc gatgtcgcgt agcacgccgc gctcagccga gacgtccttc 274621
ttttggccgc ggaaaatctc gaccgcctga tccaagctct ggccgcgctt taccaccttg 274681
gtgacgtagg catagccgga agaggtcact tcacccggcg tccattcccg ggtcacgtag 274741
atggtgttct cgtccaccca ggtcacggac tgcttgcctt cgggtaggac gaagccttcc 274801
ttaacgaatt caccccttggc aatgtcgaat tcgcggacca catccgcatc cttgccgcca 274861
tcggacaggc ggatgaggca gagattgctc gtgggcggca ggcagtcccc gccttcgaat 274921
acccaggtct tgccctcggc cttggatagc gcatcgacgt cgagaattgt gcgccattgc 274981
gggttgccgg acctgtagga ctcccaggtc gtgcgccgcc ataggccctg cacgtgcgtg 275041
ccgtcctgcc agaagttgtc gatcatcccg tcgcgcgcga agctgggcga agcaatgcgg

Figure 3 (Cont.)

275101
tcggtcgcct gtaggatcgt cagagcgtcg gcctggtact cgctgtaacg cggatctttc 275161
gacagcttat cgacggtcga aaggttatgc gcctcgaccc aggtcatcgc cttgtcgccg 275221
tcgatctcgt tcagataggc gcgaggatcg gaggcgtcct tggaagcttt gttggggttg 275281
gaatcaatcg ccgtggcgac ggtggtcatc tggggctggg cgggagccgt catggtgacc 275341
atagtcatcg ccatcatcaa gctgttcaga aatgtagtga gcatggtttg cctcttcgaa 275401
agcctcgata aacgtattgg aagcgtttaa aatcaatcgc ttcgcaccct tctcagcaaa 275461
tgctgtgcca gtctgtgtgg gcaagagctg tgccagcccg gtttttcgg ggtcattggg 275521
aggccgttgt aggagaagtg gcactgtgtg tcgcaaccgc gaaacggcgt tggacgacgt 275581
cgggcgcggt cggatccggc acttcaggga gttcgcgcta tagggttgac tcgggattgt 275641
cgacacccag ccttgctttg tggaagaacc gcgcgtctgc gtatgaagag ccgcgccgtc 275701
agcggcaatt tggtcaacaa gctcggggga tttttccgaa aacctggtag gccggtcaat 275761
tcgtcatccc ggactgtcca cccaagggcg cactccaata agggtcaagt tcagtgctga 275821
ttgacacctc cgccagaccg ccgtcgctca tcaggccgtc ggggacccct caggagcttc 275881
cggatatcgg acctatcatt ggcgagaatt ggcgccacgg ctccgaacca gcctagaatg

tcgtgatcga cgtactggaa gatatcaatc tactgccaaa ccagttcggt ccaaggcaag 276001
cttccacctt accttgaccg tgcactagag agcgagcgcc tcatgccgga agccgggcgc 276061
ccgacatata tcaacatccg cggcgtgcct tatagggccg agttgctgga agagaacggt 276121
cgctcacggg ttcgtattta tcctgtgact ggctgaggaa tgcgcttgag ctgcaatctc 276181
ggttgtaagc ggagcggcgc accgcgggca agccttttac cgccccagcc actgtcatag 276241
gcctgctcgt accaagggcg ctcatgggaa ctgccctgcg caatgatata cgagcctttg 276301
gttagatcga aaacggcgaa cggaagttca acttgtacat tcgatccagg agttcgctgc 276361
tccccagtgg aagagtgacc tttcgccgtg gggcagcaac cttatgcgtt gacatacacg 276421
tatcttgcgc gaagcccgcg cccgatagga tcacgcggtt gcggacggtt tcctgtatag 276481
catgccgtcg caccatacgt gttcaacgcg gccccactcg caggctgcgg ctgcacttgg 276541
gaagaagcca cgcccatggt aattggcact tgtgttgcaa agcaacggaa tgcccgtgag 276601
cttttcatat tcgacaagta cctcggcgac cttatgctga gagttcctgg aaatggtttg 276661
cagccgcgca gatccgtcaa gatgtacaac tgcaggaact ttgtcctgcc acggcatctt 276721
cgtctggtga tcgaacaaca tgtatggatc gggcgttcct ggactaaata tatccggtgc 276781
acggtcctcc agacatattg gcgcaactgg ccggaagtgt tcgcggaatt tgatttcgtt

Figure 3 (Cont.)

276841
aagatgatct ttcatttccg gcgaggtcgc agccgccaga atgcttcttc ctcccagtgc 276901
ccgtggtcca agctcgctgc gcccggaaag gaaaaccacg ggtttgttgc tggcgaggat 276961
ggcggccact tccgagatgc tgcacgggct agcatgccac ccagctggta ctttgcctgc 277021
ttgcaggctc gggccgctgt agactgacca gtctaatggc acgaaccctt gctgggccac 277081
tatttcacag caggctgcac caatcgcaga gccgctgtca ttaggaaagg gcggtaccca 277141
aaccgaatcg aacaggcctg tctcgcgcag cgcactgttc catttgatat tgagtccaca 277201
gccgccagct atgcacagat tgcgtgctcc cggcagggga tggtgctgca aggcgttcgc 277261
catttcgtca acgaggagac gttcgaggaa aaaatgagac gatgcaagca cgtcttcggg 277321
cgcctctgcc cccaattgga gcgcgctggc agcgaaaaaa tcgtgcacgg ccgcaagtga 277381
ggattccgag ttgttgatgt tcgcacggaa ggcgcaggca agcgcagtat cgccggcaaa 277441
gtgttcttga tagagctttt ggaacacagc aacgatgcgt tcgtgaactg atcccagtgc 277501
gataaaggcc atcagcttgc cggcaacgcc gaggtcccag cccccgcggc tcgtctgctt 277561
atagggggccg aagtagtggc ccgcggcagc gtaggcctgg cctgttaccg ggaacaacga 277621
tttgacgaag ctggctcgct tgccttccac atggtagagc cgcggaaata tgcagccgtc

Figure 3 (Cont.)

277681
ccacaccagg caaagcgcag ggtctccgga tttggcaaag gggctggtgc agtatgcaga 277741
ggcgacatgg ctcgtaacat gcggatagct tctgtagcta aaaacccgat caccaagtgt 277801
gaggccggag ccgccgatcc aatcgagaag tccctcggcg tggcgttcaa cgtaaggcgc 277861
gcctctgagg ataacaggag tctccccact gaggaccttg aactgcgact cggcctcacc 277921
gtcccagccg tcgatgacaa actgatcaac gtctcgtgca ttgaccccgt tttccgccag 277981
agccgccaca acagcatcga gattgttgat ttcttgatag cgcgaattgt tattccgctt 278041
ctcctgctca gtacagaaga cgagccttcc atcttcgaca acggcgatag ccccgtcatg 278101
ggttaacttg atgccacaga cgcgcatagt gtctctatcc aaatcaggta gtcgatttct 278161
gaaaacggga aagcaagcag tcttcattga ccgatgcgcc gcggcaataa agccgctcca 278221
cctcgatcaa cgtttcgttc aacatcgcga tgacggtctc ggcaccggcc acatgccccc 278281
agcgccggca attagcatcg attgcggatc caaaaaccat gtgcccactt ggcgccagca 278341
tgctcaccag gttgtgaacg gcggtgcgta tcgcggctac atcctcgaga taataaagaa 278401
cttcggccac gacgatcaga tcgaatagct gctgagtcga gaactgtcga acgtcagcga 278461
ctatccagtt gatgtgagac gattccttca tccgttgcct cgttcgagca atcgctcgcg

gcaccacatc aatcacagtc agccgcttgc aataaggcgc cagtttttcc gtgaatgcgc 278581
cggccgcgca cccgacttcg agtgcgttgg tgataggacc ttgggaaagc gacaaccgaa 278641
gcatctgcga atgtcgctcc tgctcgaacg cattggcgtc gagccgccat gggtcctccg 278701
ccgccagctc acggtgcaat aaatgatagt tgttgacctg cgtcaaattc gcctccgaga 278761
cgccgtgcac ggatctgcaa agactcttgc acatgggtgg gcagagcgag gcgcgaatcc 278821
ggaggcgtgg aatgcacgcg aattcccgaa aaagcggtcg ccggcaacga tggctccgtc 278881
aatactgcta cttgtggccc cttgagttcg ctcgaaagtc atacttttct gatgcagcat 278941
caagcaaaat tcgtaaaatc gatttttgtg atgccaaaca tccaggttat ggaagtttcg 279001
ccagttccgg tcactccaag ggcgggcgtg ttggggctgc tcggcttgat cgcattcgtc 279061
tggagtgaag agttggagta gtcgcccgat cgttgagagg ctctcgatgg atcgttcagc 279121
ggcttttctc aacaaggctt tgagctttga gagtgtgtat tctcgatcgg gtgaaatcgg 279181
gccatacggc gggagctatc caagggaggc atccatgtcg aaatcacaat tgggtggatg 279241
tgatggagac gtgttccagg cgcttgtggc agatgccttt gggattctca gacggcccga 279301
tcgatcctgc gcctgttcag ggagcagctg ttgttgctgg acgggagggt ggctgctaga 279361
ctgggaggtt gcaccagcgc ctatgaaggc cgtcgctttc cagtgaccat aagggacgct

Figure 3 (Cont.)

279421
gatccgcgag cgttctccta tacgggatcg accgtagcgg tgcgccatac tgatgaaagc 279481
ccagggtctc atcgttacaa tgaaacgttc cggatcaagg tcaagttggc tgccgaacca 279541
gacttgccgc cgcttcagga tgtcaggata cgaaatccgc gtactcttgt gtgctgctgg 279601
cgatgcgcct gatgtcgcca cccaagaatc gcctcactcc ttccttgaag gaagctcggc 279661
cgatctcgat aattgacgac cagacaaaac aatcgaggct cagttgtctg aggaacgccg 279721
gttcctttga cccggccatt tcaagctctc ccagcggccg tgtgcgctct catgcgccat 279781
gtctccagca tcatccaccg tacccgactt gatacgcatt catccatggc gtggatcttt 279841
gccatccaaa taaacagtta tcgcaatctt ctgaacggcg atagagaaag ttgacttaaa 279901
ctgaaagaga gaaggcgaaa ttctttcgcg atcgctttta gactagaggt gctctgatgc 279961
cgggaactcg gtaacttgag ctttggaccg acccggatat gaatgacgag cggaactacc 280021
gatcaatttc tcgaagtcct ggaactacac gattggactt ggcggaggat cgaactgttg 280081
cttctcccag acgccgcgac cgcatctgcg tgagactctc aagagcagga ttaggaagtc 280141
ggcctgacgg acatatgcag aatggttctc gatactggaa caactcaaac gtggcgggat 280201
ctgcgccagt ttgcgccgta gccggtcttc cgaggcgggg tccggagtat cctcggcgcg

Figure 3 (Cont.)

280261
tcgtcactga tactactccc gatggtcggg aggggatttc gccaatcaag ctgggggaga 280321
cgacgataat cctggatcta cacgggcaag ggctatcggt gtcagcgacc gccaaacaga 280381
ttggctacgg attgcaagaa tgtatagcgc ggcgatcagg atgagacggc ggcgacaatc 280441
tggatgagac tcttatgtcg cggtcggcat gaaggtatca tgttgattgt cgctggcaag 280501
ggtctcatcg tgttctgatt gtcgctccgc gacaatcagg gaagcacttt tggttgtcgc 280561
gaaggcggcg ggtctgccgc ggtggcgttt ggcttccatg gcggaacgtc gccgatagct 280621
ttcgacgttc atttcgaaga tcgttgcgtg atgaacaagt cggtccaccg cggcaagcgt 280681
catggccggg tccggaaaga cgcggttcca ttctccgaag ggctgattgg cggttatcat 280741
gatggaacgc cgctcatatc ttgcggagat gagttcgaac agcacgctgg tttcggcctg 280801
gtccttggtg acgtaggcca gatcgtcgag gatgagcaga tcgaacttgt cgagctttgc 280861
gatggcggat tcgagctgga gttcacgccg tgcgacctga agcttctgga cgaggtcggt 280921
cgtgcgcgtg aacagcaccc gccaaccatt ctcgatcagc gcgaggccga tggcggcggc 280981
gagatggctc tttccgccgc ccggcggacc gaacaggagg atattggcac ctttggcgag 281041
ccaactgtcg ccggcggcaa tggccatgac ctgggccttg gagaccatgg gcacggcgtc

gaaagcgaag ctctcgagcg tctttccggg cggcagatgc gcctcggcga ggtgacgttc 281161
gatcctgcga tgcgcccgtt cagccagttc atgctcggcg atggccgaaa ggaaacgagc 281221
cgcaggccac ccttcacgat cggcctgttc ggcaaattgc ggccacagcg ttttgatcgt 281281
cggcagcctc aggtcattga gcatgatgcc gaggcgggct tcgtcgatgg tgttgtggac 281341
gtttttcatg cggcctctcc cgcataagca gaccccatca gggcttcata gctattgagc 281401
gatgcgagct gcacatgcac ggtcggcaac tgatccgggt ccggaccgaa gatggctctc 281461
aaggccatca ggtcgggcag tttgcgggcg tcgagcgttc tggcaagctc ctcggccagt 281521
tcacgctcgc aaccgcgatc atgagccagg gccagcaatt cgacggtgat cttgcaagcc 281581
tgccggtcag gcagttgctc gatgagagcg tcgaaagccc tgcgatattc cggccggggg 281641
aagagcttgt cgcgatagac caggttgaga agcgccatgg gctttttgcg cagagagtgg 281701
atgacgtggt gatagttgac gacctggtca tgcttgccgc tcgcgtgggc gcgacctcgt 281761
ggcaacgtca gcagatgcgt gccgccgatg aagacgtcga gacgatcgtc aaacaaacgc 281821
acacgcagcc gatggccgat caaacgggag gggacggtgt agaagacttt gcgcaaggcg 281881
aagccgccgg tgcgcgacac ggtgacgact acctcctcga agtcggtggt gcggcgctcg 281941
ggaagcacct gcagatgcgg gcgctcggca tcaatgcgct tgccatgcgc ggcattgcgg

Figure 3 (Cont.)

282001
cggctgacga tctcgtcgat gaaggcgcgg taggagcgca gatcgtcgaa gtctctggtg 282061
ccgcgcatca ggagtgcatc gcggactgcg ttcttgagat ggccgtggga gctttcgatt 282121
gagccgttct cgtgggcgac gcccttgttg ttgcgcgtcg gcgtcatccg gtagtgagcg 282181
cacagctcct catagcggtt tgtcagatcg accttggcat cggcatcgag gttgcggaag 282241
gcagccgaca ggctgtcgct gcggtgatag agcggcgaac cgccgaccga ccacagggcg 282301
ttctgcaggc cctccgccaa ggcgacgaag ctttcgccgc caaggatgac atgggcgtgc 282361
tcaaaacccg accaaaccag ccggaagtga tagagcagat ggtcgagcgg ttggccggcg 282421
atcgtcacgc tgaggctgcc catgtcggta aaatccgaca gccctagtcg gccgggctcg 282481
tgcgtctggc ggaagatcac ctcctgtgct tcaccgtgaa ccgcccgcca tgaccggatg 282541
cgccgctcaa gtgtgcggcg aatgccttcg ggcagttccg gatgacgccg cagcatctcg 282601
tcgtaaacgg cgaccgcacg aatgccggga gcggccttga ggagcggaac gacctccgca 282661
tcaaagatat gctcaagcgg atcgggtcga cgccgaccgc ggggcggctt gttctgcgac 282721
ggaaggcgct gctctttctc catgcggaac gccgtcgccc ggctgatcga cgccttcgcg 282781
gcggcgacct caacagaatg cgtttgtcgg tacttcatga ataatctcat ctgatgatcg

Figure 3 (Cont.)

282841
gttacatggc gacccggcac aaaggtggtt ctccattcca gaaaaccgcc accgtagcgg 282901
gccgaccgcg atcatgagac gcctaaaaat tgcgccgcgg cgggggtgta actccggtcg 282961
ggctacgccc tcccttcgtc acaccccac cgccgagtct catcctgatt gacgctgagt 283021
ctcaccttgt ttgtcgccgc gcaaagaatg cgcgcaacta cgtcgagcgg gggctagagg 283081
ctccgaaata tggccaacgc aagcacacaa tgtttggcga ccggctcgcg acctatcttc 283141
gcgaacgcgt gaaggcttgt cccgtccgga ccgcgcggcg gcttttccgc gagatctagg 283201
gtctcgaccg tttctgcagc tatacggcgc tatccgggct gacaaggtga ccgggctcga 283261
aaccggcgcc cgcaactaca tcaccaagcc ctttgcctcg ccggagtacc tggcccgcgt 283321
gcgtgccgcg ttacgcgggc cgccggaagc gtcactgcaa caggattttc catttcgatg 283381
tctggcgaat gggcgccgct tgcatcgagg aacggattgt aaactcaagc tctctgcgag 283441
ttcactcttc tgatggcctt tctcaaaaat cagtgtcctc tcgcatgagc agcttctggg 283501
gatgatgcgc gtcaattttc ccttaattcg cgtcttcgcc agctcgccag cgggctggtg 283561
gatctgcatc gcctcctttc gtcatatgga ggggaccatt tcaaccttcg cggtgcttgc 283621
ggtgcgctcc ccttcacaac cagtgatcag aatgctccaa gcactccatg gggcggtccg

gagccgaggt ccacacgccg ggacgatacc gcaatgcggc tgtgtatgct ggcacgctat 283741
caccagcaaa aaggcgcttg tagagacaat gtcccccagt ccatgttgag gaggggagat 283801
attcgacgat ggcacgttac gatgcccggc tgaggggcat tggaaaggca catgcctgca 283861
gcgcgttcgc aggccacgat ttcgagggta ggaacattat gaagacaccg tggaaatttc 283921
ttgctcaatt ggcgtcgcgg cgacgatcgg caagcgtgca agagaatttt attgcgcctg 283981
acactgatcc cgaagtgatc gaaagcgaaa cggaaaacaa gtcgccactt ccgttcgaca 284041
agccaacgca agcttctggc actcctgatc acgattccgc ggttgatcgc gggtcgatgt 284101
tatcggacca gctggaaagc gaccccaatc ccctgcagga aatgaacctc acagctgaca 284161
ttcaagagcc tggaacccct gcccgaagtg aaaccaaaca atcggatgcg gctgggaaga 284221
ggctggggcc gcaaagccag acaagcgcaa attcccaaaa gaagccggag atcagatgtc 284281
gagaacgctc caagaacgcg cgcgccgagg gggttgcgca gagcgctgtc gccacaaatg 284341
aagctgagac cgtacaaacc tcgtcgtccg gggatccttt cttcaacgaa gtggcaatcc 284401
tcgacgagga aatcaaagag ctgcgacgtc tgctggctca aaaactttat ctgcagaacg 284461
ctcagctcaa aaagatgctt gagcgtttcg acgcctcgtg agttcgcgtc aactgacgcc 284521
ggaccgagaa aatgctgcag gacgttattc gccgcgagtt ccgaggcctg ctcgaaagcg

Figure 3 (Cont.)

284581
gggaaccagt ggtgtgccca gccgacggtg aaggtggagc agtgtcccgt cacggccttc 284641
gacgatctcg aggagattat tttcgcgctt gatcaaaaga gaggttcggg gcgccaatcg 284701
ttcaggatca acagctgaaa atggtgcgcg gcaggcgcgc atatcgccct ccacgagcaa 284761
gcgtcagttg ggcaaacggc cttgcgccgc actggtaaag gacggcgcaa ccatcgcatc 284821
aggccttgtg cccgagcgca agccaaccag ctctctccga cgccggacgg tcctcggatg 284881
gccagatcgt cgtgcgcatc gatccagtcg ccgccaatca agcctcatga acaacgcgat 284941
cccggctgtg ttcgcttcgg cagtggcctg atggcgtagc ccggcgaacc tgaggcgtgc 285001
ggcgagcttc cggggcgcga aatccagtcc cgttcgagat taggcgccca agcatctttc 285061
gttgtcctta ctggcgatag cgggtccgca gatgtttgtg tgatagatcg gcttatgcgc 285121
gccactccag ctgacacagc gcttcagtcg agatgattgg cgacgatcgg aacggaccag 285181
accgtggaat tcgtgccctg attcccaagg cacgagcgca ggcgtgtgtc gaagtcgact 285241
gggcgcctac tgtgccactg gatttgtcga gttcccgaca ttcgggaggc gagacatagc 285301
gccaccgaag tgatcgcgtt gctttggaac gattttcaag cttggcacga cacatgcata 285361
gccatccaca tacacgctgc gccgccgcgc tggagattcc gaagcaatgg tgaagaactt

Figure 3 (Cont.)

285421
ccttggatca tcggttacat caggctcggc tggagcggaa catggaaaga ctttgcaaat 285481
tccgacttta cgatgggtgc gccagtcgaa gacttcgatc atggcacttg taatttgtct 285541
aggcaggata gtgaaaacag cactcgttac cggcggctcc ggatattttg gggaactgtt 285601
aagcaagcaa ttgcttagac aaggaaccta cgttcgcgtg ttcgacctga atccgcccgg 285661
cttcagtcat cctaatcttg aatttctcaa gggcacaatt ctcgaccgaa acgcggtcag 285721
acaagcactt tccgggatag acaaggtgtt ccacaacgtt gcgcaggtac cgctagccaa 285781
ggaaaaagac ctattctggt ccgttaactg cggaggcact cagatcatcg ttgacgagtc 285841
ggtcgcgacg gggatcgaaa agttcgtcta cacgtcctcg agcgctgttt tcggtgcgcc 285901
gaaatcgaac cccgtaacag aagaaacaga accgaacccg gcggaagatt atggtcgcgc 285961
gaaactcgca ggagaaatta tctgtaagga agcaatgcag cgtgatggct tggatgtggc 286021
gattgtgcgc cctcgcacag ttctcggata tggccgccaa ggcgtcgtcc agattctctt 286081
tgactgggtt gaacgggggc tcgatattcc agtgttgggt gggggtaata acaaatatca 286141
gttcgtgcac tcggatgatt tagcatcggc atgcatagca gcctcgaatg taaaggggtt 286201
tgccacatac aatattggtg ctgccgagtt cggtacgatg cgtgaacttt tgcaagtggt

aatcaagcat gccgaaaccg gaagtcgaat caaatcgatc ccgatgggac cgactgccct 286321
tgcagcgaat ctggcaagcg cgctcggcct ctctccctta gggccatacc attcgctgat 286381
gtatgggaga gcaatgtatt tcgatatctc caaagcgcaa aaggaacttg ggtatgcacc 286441
gagatactct aattctcaga tgatgatcga gacctataat tggtaccagg ctaatagggc 286501
ttctctcgga aaaggcggag ggtcacgtca taaggcgccc gtcaaacagc agctcctggc 286561
attgcttccc tatgcactgc ggctgatccc aggatgaacg cggttccgat aatcttggtt 286621
tttgctgcgg gcctgaattc ctgtattggc aatatattgc tgaaatgggg ccgggcctca 286681
ctgcctccca gcgccggact tgccgatacg tttctcactc ccggctttgt aggcggggtg 286741
gtattttatg gcattaacgt tctactgttt gcaaaggctc tggactcctt ggaggtatca 286801
gtcgcttatc cgattctggc aggctccgga ttcgcgatgc ttatcatcgc gtcgcattat 286861
ttttttggag aaccattcca ccttcacaaa tggatcggtg ttgccctcgt cctggtgggc 286921
attatttttc tggcgcgagg aggctaagtt ggcattcgat cgagtgatcg tggcaacatt 286981
gacaccttta tggccattgc tcgacgcgga agaaaggcca gcggtggtgt cagaagtcgc 287041
acgcagtgtg acccgttcca tcgcacttgc cccatttcac attcgctttg cggtcgaaag 287101
cgtttcgatc gtcataggtc tctgcactgt cttgatttca gcgggtgcag gcggtccctt

Figure 3 (Cont.)

287161
ggcgcgcacg ctccgaacag acagatttta tcggctcctg caaagaatgc ccggtcccgc 287221
cggttctgtc atacgccttt atcgctcgat gacgctgctt gcattttatg atgaagcgcc 287281
ggtagccgaa aagctgttgg ctgcacggcc tgctcaaacc tcataggctt gaatatgaag 287341
ggcgggtttt cgttgaacag cgaactgcaa ctggaagccg atgcggtgat aatcggttcc 287401
ggcgcgggcg gtgcaagcgt tgctgatgta cttacagctg ccggtttata tgtgatcatg 287461
cttgaagaag gtgggcatgt tccctcatca tcggcttctc ctttcgcgag tgaagcattc 287521
gcggcagcct ggcgcggcgg aggattaacc gcggcgatcg gccgcccccc tattgcttat 287581
gcggagggcc gctgcgttgg gggagggaca gaaatcaaca gcgcgattgc ccagcgcgcc 287641
gatagcgacc tccttgatca atggcgcaag ctttacaaga tcgagaattt taccccggac 287701
gaactgtcgc aatattatgg tcgcgcggag acaacggtga atgcgagcct gacccccggc 287761
ccactcgggc gtcccaccga cattctgcgg ctgggtgggg aagcgcttgg ctggaaagtt 287821
tcggagctga aacgggggca gcgtgactgc aagggcgcca atcggtgttc tttcatttgt 287881
ccgaatggtg ccaagcagtc gatggcggtg acccttctcc caaagtcgat ggatcgcggc 287941
atgcggctgc ttgcgcgaac gcgcgtagac aagatccgta tcgagaaagg acgtgccgca

Figure 3 (Cont.)

288001
gtggtcgtcg ctcagttgca ggacgccggc ggacagggcg tgcacgtgcg cgtaaaagcg 288061
ggacttgtgt ttgtctgcgc gggagcaatt catacgccag cgcttttgcg tcgttctggc 288121
ctgcgtaaac gcattggcga taccctgcgc attcatccga cgatcagagc gacggcactt 288181
tttgatgaac ccgttgatgc gcaccagtcg cgccttccgc tgacagccgt taccgaattc 288241
atgcccgagc agcgcatagg cgggtcggtg ttcacgccgg ctgtctttgg cctttcactt 288301
gcggaagact ggaccaatcg cggcgatctg atgcaggctt ggcgtttatg cggctcttat 288361
tacggcatga tacgaccgcg cggagtgggt tcagtgagac ctcttcccgg tattaatgaa 288421
ccgcttgtca gtttcaaact cgcgcctgag gactggatct ctttgggcca ggttctcacc 288481
ctcctcggac aggcgatgtt tgcggccggt gcccggaagg taatcccaag tatatcgggc 288541
cacgagggct ggacaaaccc tgatgaggtc gatgaattcc ggaacaagcc tctgcctgaa 288601
aaagcgacca acctgatgac catacatctg ttttccacct gcccacccgg cgagcatcgg 288661
gacgcttgtg cagtcgacag ttacggacgt gtgcggggcg tcgaaaacct ctttgtcgcc 288721
gatggcagcg tcattcctga ggcgcccggc gtcaatcccc agatgacgat catggctctg 288781
gcgttccgga tagcggaagc ggcactcagt cattcctctc gagaacgcgc ccaatcggcc

gcaagggagt aagtgttata cattaaggtc cagtagtgag gaccgggaat tgcagcccag 288901
gggaactatc gataaatgcg ccacttgccc ttcttctcgg aaacaagctt gtagactgaa 288961
ttgttgtcca gcaccggttt gccccacaaa ccatctcttg aagtgactac aagagttcta 289021
caacgatatt tttccttcat aattctaaga tggtcttctg ttgccaggcc ggcgaaagcg 289081
cgtacgaaga aattatagat ctctgatgct tttttaggcg tcagttgagc agcataggcg 289141
cgcaaaaaat caagcgtggt tccgcaatgt cgtctctgag acaaaattgc ccaggagata 289201
tttgccggtg tataggtcac acttgctaga tcaagcgggt tgttggccac cgcttcattc 289261
ggaggcgtta cctcgcggac agctttccac atctcagggg atgctttgaa agcagtgcct 289321
tcttctgaat caggtccttc gacctggaat ttgaaggtgt tcgaatagac agacttggcg 289381
ccaaccaaaa ttgagggggc gagtaaaata atagctgtta tggttgtgag gcgcccaact 289441
agcgtgcctt taccgatagt tgtggagaaa agcccagaag tcagcgcagt catgacaagc 289501
atagatggaa tgagtacacg ccatcctaaa tcattgtaca taattacgct atggagtatc 289561
tgtgtacaaa atagaggcgc cagcaccgag acagttaaag cgcagtcaat gtgtgcgtat 289621
cgcttactgt cgtcagaggg tctggcaaaa ctccagatga ggaatgataa atatattatt 289681
ccgaactcaa gaaagaccag aacaagccag aatcctggaa tgtccaaaaa ccaataatcg

Figure 3 (Cont.)

289741
ccggcaaaaa tgggaaaaac ccaaaactcc acgaccttcc tagtgtgtaa tatagcggac 289801
tgttcgcgaa taagcacggc tgcacagagt agggttatga cgactgtgac cgaaagtgaa 289861
atgagaacct ccagaagccg tttgaccttt agcacatgtg agaccgacag cgcccccaca 289921
aggggtaata tcaaaagcag cgataagctg cccgcccaca tcgagctccc ataagcagaa 289981
gccaagattg cgcccataaa tactgccaga gccatattgc gcccggcgtt ggaatataaa 290041
attcgcaggt atgccatgat ggcaatcagg gccagcgtcc cggaaaagac gtgctggggt 290101
acccaggggg cctggataat ccacgtttgg aggccatgtt cgggtgccat ccatttctcg 290161
agccactttc cgaagacaaa tcgcacggct ggcttaagcg aaccgacgaa taagagcggg 290221
agtgaccacc aagcggcata tgcacttctg cttcgcgcca cagccagcca agttacgaca 290281
aacgtggaga aaagcgcggt catgccggta agagcgatgt cggcctccca gccggttgcg 290341
cctgttatca cggatgaaca ggcggctatg aagtgccaga cgtagtagta aattagggtg 290401
ttgggagatc cggcttcgga atggaatgga ttggcgggag gcaatccgtt ttgagcgatt 290461
tcatttacga tcgcgatctt tgcatggtcc cagatcgggt gaccgacgcc gacgctacct 290521
ccataatgct gcggaatgat ctcgaaagct ggcaaaaggc agaggagaaa cgcaacagtg

Figure 3 (Cont.)

290581
aaccagcaaa agccgggact cgcaggcgat cgcaggagcg ggtctatggt gcctttcgag 290641
agccagaatg cgacagcgga caaaccaagg acgatcagca tcaggttgat cgctgtaatg 290701
ggtaaaaaat gaaaaatgga aacggctacg gcgccgaata tcccaagtcc gatgaccggc 290761
gacagaagca ggcgcatcgt ggtgttgctg tcaaaatact tcgaaacagg ccaacctatg 290821
gcatatccta tagcacttga aacaagtgcg ctggagacaa ttgaagaagt ttgcaccagc 290881
actgacggcc tcacagctcc tcggcaagct tgactagaat gactgaccgt ttttgacgca 290941
ccaatcgacc gaacgttgca tgccctcgcg caacgcaatt ttcggggcgt atccgagcac 291001
ttttctggct ttggtgatat cgcaggcaat tgtcttgttc atttccgaca gcacatggat 291061
cttctggtga tagatcccgg catattggag ggtagcatca agtatcgttg cggcgccgcc 291121
tacgatgtcc ggcagacgga aagggttggg ctttaccgtc atgccgaaat cttcgtgcag 291181
gaccattcca acgacttcaa tgatttcgtt catggtgtag ggcgtctcgt ctgcaagcca 291241
gaaaatatct cccgcagccc gctcgtgaac tgcggccaga agaatgccct gagccaggtt 291301
gtcagtgtaa cccatggatc ggcggttccg ccctgatcca ataatgggaa acttgccttc 291361
tttgaccatc ttgaaaaaaa gcgtttgcct tgaaggctga ttgggaccgt aaaaccaggg

cgcgcgcacg atgacaatct ccatagtgct gccagcagcc acttccgcac gcagtgcccg 291481
ttccatcagc atcttggagc ggccgtatcc cgcatgggga tcataggggc tttcctccgt 291541
gaatctgtgg tccgagtgag gattgaagcc gaccggcgaa ttcgacgaca tgacgacagc 291601
gcgccgcaca cctgcctttt gcgctgcagt aacgaggttg atcgtgccct gtgtgttgat 291661
tgcttcaaac tgggcaacat ttttgggatg aatgatacct gccatgtgaa tgagaacggc 291721
gccttcggcg ccggcgacga acgcgcggac ggactgcatc tcccgaaggt cacctgtcgc 291781
gatttccatg ccctgtttgc gcaactcaga tatgtcttct cccttaggca cgagggccct 291841
tacccggaag cttccgtttg cgagaagtcc tgcatccggc aggcccgtcg tcaacgcggc 291901
cgccacccgc ccgcccaacc agccggcagc tccagttagg agtacgagcg gcgcattcaa 291961
agttataggg gttatctctt gcatattggc atttgcttaa tttcacatgg ccatcacgaa 292021
cgccgacgcg atgagggcgc cgataaacca gctggtcttg tcgttgagcg cgaagacaat 292081
agggtcgtcg tgcaattcca tacgatgact gaggagccag atcctttgca gccaaatgga 292141
aacgccgagc ggcgcaacat aaagccatgc tggattatga tataggtgcg tcactctggg 292201
ctcgagtgcg aggaaaagca gcatgatgac gatcgaggcc gaagcggacg caaggccatg 292261
gcccaaggtt agcggccagt cgccaggcaa gtatccgcgc ccttcgatgg tgtccttgcg

Figure 3 (Cont.)

```
292321
atttgagcac gcgcgcattg cttccacatg acgctttgcc agagccagcg aaatgaagaa

292381
cattactgaa aacgaaaaaa gccaagggga gaatgccagg ccgttcagca cctgacccat

292441
gacaatcctt aaggtgaata acgccccaat aactgtcaca tcgagtaacg caacacgctt

292501
caggcggaat gaataggcca gtgtcagcgc gagatagaca gaagcaacca gcgcgaattg

292561
atggtccaaa aggagggccg tcccaatgcc tgtagcaagc ataaccagac acgccagaaa

292621
gccgttcatg acactgattc ggcctgcagc gattgcccgg aagcgtttgg tcgcatgcgc

292681
ccggtccgcc tccagatcag ccagatcgtt gataatatag gttgccgaaa caatcaggcc

292741
gaaagcgaga aaaccgaacg tcgttttcag tacagcatgg aagtcgtccg caatgcggcc

292801
gagaaacaga ggcacgaaga tcagcacatt tttcgaccac tggtgtatcc tgagttcaga

292861
aagccaatcc ttcaccggat gacttttttc aggactgagc gtcctaacct cgacgccagc

292921
ctcacggagt ttgctttcga actttactcc gtcgccaacc agaacggctc cggaagccgc

292981
ctcccagatc ggcaggtcgg cggcactgtc gcctgcatag atgaatccct cgggaaagct

293041
ctcctgaagc cattgcagtt tgcgccggct cttgaggttc agtgagccac tactcccctt

293101
ggcaccgtcg aaaccgccga gatgagaaat gatatcatct gctatgctct gatcagctgc
```

Figure 3 (Cont.)

293161
cgtaacgaga taggtttcac gcccggcaga tctcgcgcgg cgtatcaggt caagcatctg 293221
ttcacggtag ggaagcgcct gcggctcaac cgaacggact ttcgccagag cttccttcag 293281
ggccgggcgc cccttaaacc agtttggaat cgtgcgaagc aactgctgcg gggaatggaa 293341
gaaggcatca aacaggttct cgtgaagact gtctgatttt atcagtgtgc catccaggtc 293401
acaaatcaaa ggcaacttac gatcaaagca gtccagatca agcaccttca tttcatttcg 293461
ccgctgtttc atcagtagca tcctccagcc ggacgccccg aaacaggtcc aaagtacggc 293521
gggcgcattt tcgggaggtg gtgagcctgg cacgcgcgtt ctggtatatg agctgacgag 293581
gacatctgct ttttgcctct ctcaaacgac cgctaagcta tccatcccca ccggggtcgg 293641
tatctccaga cgcatgcgac agaggagcat caaatgttgt gccagcttgc acaaacttat 293701
gggaagagac tttctgtata ttgttcaatg acgtgcatgc gtggcgcctg atctcagctg 293761
gcgagcgctg tgtcgcggac acgacagaat ggacagcagg tgtctcttgt ttgacgttta 293821
caggaaccgg cgccatagag tgatcagtga gcgggacgag ggagcttgga taaccgcggc 293881
attccgctgt ccgccagcag tcgctgcaca agtcggtacc caggcggcca gcttctacaa 293941
cgacgccgaa cgcaaggcgg gtagggcgcg cggcttgtca tctgagcggg agaaccgagg

atgctcgtca ctcggctgaa agaggagctc gcggccattc agaaggcacg gcaaagtact 294061
gaattggctg acactccgcg acggaacggc gcaagagtcg cggccgcaac tgcatccaac 294121
ctccgaatgt ccaattcgca ttccggccag ctgcgatcac cattataggg tggcgaactc 294181
gtcgcgaaat gcgtctgagt gtggatcgat cttcggaact cattgcggcg accccagccg 294241
gatgggaatg ccaatcccca agatagtcga ggtcgcccgc ggtgttcctg aatgcttcgt 294301
ctatctgctc gacctgccat gagtggtccg gaatgaaagt atggcgacca tgcagcgctt 294361
tcgggccagc acctacaata tcaacgacaa cccgatcttc gccatctctc caaccgagga 294421
gaacaccgcc ggtctcgagc ggaaagaata tgttggcctg ttcgattatt acttgagctg 294481
cgtcgcgccc caaccaaatt gtcatccctg tgacgctccg cagctgcagc tcgaatgtgg 294541
tgcgatcgtc tcggctttcc accgcgggag aatgcggcgg ccattttcgg tcagatcaag 294601
aatggaaagc tgccagtcac ccgaatcgta cacgtccggg gcgagcagtc cgatcgtgct 294661
gcgtacaact tccatcgaca cttcctgcag gtcaaaggcg cctccggtga acgttggcgc 294721
gttgcagccg gtcggaacta tcgtgcccga gctgtcaata gttgggagcg ggagcgtctt 294781
gccggaccaa tgctgctgca agcagacata acaacccggg gctcccggtt tgaatctcgc 294841
cacaacgcct ccggccgcgc cttcggttgc gtggccgagt acgtaccgct ttcctatgct

Figure 3 (Cont.)

294901
acggcacatg taggccaagg cgccctgaca ctcggtcgag gccgaagtgt ctaccacaat 294961
gtcggcgtcc tcgatcaatg ctcgaagcca acgcatggga ttcccctcga gtttgcggac 295021
gtcgtccaca ttcgagattg ctgagcccac tttagcgtgt ccacgcccga catttgtcca 295081
agggtagttg tgatagagga aatcgtgcag cgcggttgtc tttggcaggc cccacaccga 295141
acgacccagc gcccatctga ccgtgttgcc aggctcgacg agatcgaaat cgatgatcgt 295201
cagctgaccg acgcctgagc gcgcaagctc gactgcagcg aaactgccga tggcgccgca 295261
ccctacgaga acaacctttt tgcttttcaa agcactcgcg acaggcagtc gcgagagcat 295321
atcgctcgac agacggtatc cgcgcaccaa ggaaacctgt cgccggcggc tgccaggcac 295381
gcgccgactg acgagaaaga accaaccgtt gcccttgtta tcagggccgt aggaaagctc 295441
ctcctgaaaa accacggcgg taatcgatag atcgtcgtcg gcaattgatc cgagcttctt 295501
caggtgagcg gggaagaggg ccgattgtcg ctctatcgcc ttctcggccg ccgccaaaat 295561
ctcctccggg gcctcgggga atggcggctc caggcgtatc cagcgcccga tgacgttttt 295621
ccatgggccg gcccgtttcg ggagatcgaa gggcttcgcc atccaggtgc cgctcaatgg 295681
ctccactttg ctcagaatgg cttgaaacgg tggagacctt cctcgctcca ggcggtcctg

Figure 3 (Cont.)

295741
gagcaggaaa actgcggttc cgaggggggc atttggaacg gtctgctgcc catcaaaaaa 295801
gaccgccgaa tactcctcgg caacatgcat atgatatggc gttacagggt cgggagcttg 295861
ttcttcgagg ctggctgcct cactccactg ctcgttccgc cgcagtgtca tgacttgcag 295921
gacctgcgat aaccgctcgg ctatgaagtc cgcgaccatt tgatgggggt accactgggc 295981
agagtcctgc gtcagcaggc acaaatccct cgtaaaggga ttctgatgcc gctcgagttg 296041
cagttcaggc gcggatatcg agggtcggca gaacggatgc agcggcgagt agccgacatt 296101
aagtcggatg gacccggcac tgtccatcgg ccaaaggacc tcgaggatca aggtgccgtc 296161
ctgttggatt aacggccggt gagaggcgcc gtgcccctca taggccgcca actcccgggc 296221
atacaagcca ggataggcct gccaccaatt gtcctgatcc gagccgcgct taagaacgtt 296281
cacctccgtc agccgaccgg ccggtgggac gggggtgag agggcactgg cgggccatcg 296341
gggcgacccg gagtatggct gggcggcccc ttcgggacgt cggggtgttc aggatgacct 296401
tcccggcccg gcttattcgt attcgacatg agtatctcct tacaatacag gcctccgttc 296461
ttgacggagt ccaattccgg attaaaattc tggatgagtc cagatatgga ttatataaga 296521
atggactcat tcgttgttca agtacacact tggacttagg agcagatttt tatgacagaa

ccagttcgag ggtcatctcc aagcagcgat tctgctcgag tccctgcaga actcgaagcg 296641
ttcttccgca ttgccgaccg gtggcgtctg tctgccgacg atcagatcaa gctgttggga 296701
tctccaggtc ggtcgacgtt cttcaagtgg aagaaggcgg gcggcacgtt gcccgccgac 296761
acggttgagc gcctgtcgca cattctcagc atttggaagg cactgcgaat tctctttacc 296821
atagaggagc gcgccgacga ttggattcgc cgacccaacg atttcttcga tggagcaagt 296881
gcactcgaca ccatgctgca ggggagggtt gtcgatatct acagagtgcg ccagtacctc 296941
gatgctcagc gtggcgggtg acaaatggat gaggtcgcca tcaaggacga gttttatcgg 297001
ctaattccgt cacggttccc gccagtcgcg gtgtacgagg gattggtcag cgaggacaag 297061
atcgaggcac ttgtcgaaat agagaacaag acgaatccgc gtctccagtc ggagggccgg 297121
ctgctatccg ctcataccga tccgagggcg ccgaggctgc agaactggaa cctggctccc 297181
ttcaagtacc tgaacccgga gggaatccgc tttttcgacg gtagtcgccc ggcactggaa 297241
ttggcagacg atcgtcagac cgcgctcgct atgtctgtcg agcgtcgtca ggccttcttg 297301
tcgcgaacca aggaagcgcc aatcggcctc gatatgcgat tgctcaagac accggtgagc 297361
gggcggttca tcgattttcg aaagtatccg atcgatctat cgtgcgagga acgctggaga 297421
ttgggaggtt cggtgcccga aggcgcggac ggcgtgattt atcatccgcc ggagcggccc

Figure 3 (Cont.)

297481
tcagccattt gcattgcggt actccgaggc gacgttcttg gccgaacgat tcagacggtc 297541
cattaccgct acgtttggaa tggtacccga atatccctcc tttatgcctt tgatgatgca 297601
ggcaacgaaa ttcgcccaga ggtattgggt ggcgcggatg atgcattcgc cgtgtgagca 297661
ttaaatctag caaaacacac ctacattccg cttaaaatcg atttcgcctt ctgcttattc 297721
acagtgatat tctcagcagg caactctacc cttctcgtcg ctttgtgacc tcctctcgaa 297781
accgggaacg gagtactctc atctcggcct tctctaaacg cctgctgatc ttctcagccg 297841
tctgggccag gagcctgccg tcgaattcgg ggggaactcc cctgttgtcc ttccagaaga 297901
ttttaattgc ctgaaggtcg gcctcttgga gatctgcgac gaaagagcac gcggcagcaa 297961
tgataagtcc attatcatca tcggcagttt ctgcggcggg taccgccgct ttggcgggcg 298021
atgccgctat agcggtcatt gcaggctggt gaacggaccg cagcgacaga aacttttcga 298081
cggtgagctt gtcccattca gaggtggtgt cggcttcctg tctgagggtc ggcgactgcg 298141
atcctcgcgc cggatgaatg cccagcaaat gaacccgaac cccatagttc tgagcaatct 298201
gcacgccgac tcggacatct tcatcgccag acagcagcac cacctcagag atagcccttt 298261
gccgtgccaa ctctatcaag tcagtcacga taagcgaatc cacgcccttt tgctgcccct

Figure 3 (Cont.)

298321
gcccattaat gaacccgagg cgcaacttga tgtcatccat gtcggcgatg gcagtctgat 298381
cagcgctcat cgctgcacct ggtcttattc catcgtacta gtaaatgcgc atcagtgacc 298441
cagtaggggc tttcgtggaa cagaacgcct tcagttcctc aatgactgac ctcgccgaga 298501
gtgacaactt cgccctagcc actttgttac cggtgagtgc agtgctcccc tgcgggaaca 298561
gatagcccgc gtcgacgaaa atagcagagc gccccaagat cccccaaccc taaaagtagc 298621
aagggctccc gcgggagccc tttgtatgcc ggcgcaacca taatatctaa tcggtcacgc 298681
cggagtaatt tatgtatgcg ccacgcatgc gcacaagtca atacgaaacg ataaacgctg 298741
caggaaatgg acgctaatga gacgcaacgc acgccaatca gacctaatcg cgctcaatta 298801
gatattctgc atatacgcag ctgcaacaag ttactacgga tataatgccg cgggcgctgc 298861
aacgcaagag gccgaagcag cctgcatcgc gcaaaatcaa tggctatcga cggacaggcg 298921
ccgcaccgac cagtccgctt aatttccggc gccggccgaa ggcatccccg tcagactgcg 298981
gaaaatgtcg acccagaatg cgaaatcgtc tgctcgcccg tcggtccagg cctcaagacc 299041
gcaatgcgcc acggcagtcg ctgcctcgtc gccgaacagg tcaatcgcgg cttccatcat 299101
gctttccggg tccgaaggtt ctggccagat cgccttcatc atagtcatac acctaatcgc

tgcttctcgg gcgtgaggat actacgcgca tttgagcgtt gcgcaaacga tcgtttatac 299221
acgcgttgca caggccgcag aaaacgcaat gaaatcagct gcctagagcc gcgtatccgg 299281
gcaggattgc ataagcatgc tccattacgc aacggggtat gatgggcgag aagaccggat 299341
atgcaagggt ttccaccctc gaacagaacc tcgatatgga acagcgcgct ctcaaagcgg 299401
cggcaatggt cacgtccgct gcgcccctgg tcgcccctcg acgggatcag gtgaacagca 299461
ttatccgatt tgcgcgcaga tgccctatca actcgcgatc gatgtcgctt gaggccgccg 299521
acggccacag agaccttaac gagcgaaccg ttgtcgcgat actcctcgag cgtgaagtta 299581
ttgaccacct gcttgcggat cgagatcgag ccaccttcgg gtgccgcgcg gcggcaagac 299641
gatctggata cgctcgccgg tcggaagcgc ggcgctgagg atcggtttcg agcggctgat 299701
gaactggttc gtcgcggccg caacacgctc gccgacgttc tggatttcat cacccatcag 299761
ggcgacgatt agatgatgct ccatgtaatc ggcgccaaac cgttccacat atacatcgcc 299821
cggtttgttg acggcgattt ccaccaccct cggatcgtcg ataaattccc tgatcggttc 299881
aagtgcggat tccgacgtga agccggccgc attccgatca atatccggcc accgttccga 299941
tttgaagccg gccacgattc caatcaatta ccggccggtt ttcggctcta acgatacccc 300001
ctgggtcagc aactttggcc atcaagcctc cgggtacacg aggagatatt gatgccggcg

Figure 3 (Cont.)

300061
aagagaaggc tgaccatgag acaattacga caaatgctcc ggcttggcgg aagcggaaaa 300121
gcagccgcga gattgcggtg atgcttggtg ttgcgcgcag caccgtgcag gataacctga 300181
agcgggcggc gttggcgggc ctgacctggc cactgcctgg cgaactgacc gacgaggcgc 300241
tcgagcatcg gctgttcgcc cgcgccgggg tcaagcaggg ccaacggcga cgccaagagc 300301
ctgattgggc cgagctctcc atcgaactga agaagccggg cgtgacgctt cttatgctct 300361
gggaggaata tcgcagcgtc catcccgacg gatactgcta cagccgcttc tgcgaactgt 300421
tccgcggctt cgagcagcgc ttgtcgccga cgatgcgcca ggagcacgcc gctggcgaca 300481
aggccttcgt ggactattcc ggcaaggggg tgccaatcgt cgatcgcaag accggcgagg 300541
ttcgcgaggc ggaactgttc gtcggcgtgc tcggcgcgtc gagctatacg ttcgccgagg 300601
cgaccttgac ccagacgctc ccggattgga tcggctcgca cgtgcgcatg ttcgccttct 300661
tcggtggcgt gccccggctg atcgtgccgg acaacctgaa gtccggcgtc aaccgggcca 300721
acttccacga tcccgagatc aaccgcagct acggcatgat ggcgtcccac tacggcgtcg 300781
gcgtcctacc ggcccggccg cgccgcccgc aggccaagga gcagacatca cgatgcacct 300841
tgttggaatt gttgagcgtc aattaaccta ggtttgcggc taccatagcg accgcctacg

Figure 3 (Cont.)

300901
ccttttgcga gtctaacgtt agccggtggc tcatacaggt agcggtggtt ggtagcgtag 300961
cgatggcgct ttagaacacc ctcgcgtccg agttggtgta cggttgtggc acttacgcca 301021
aatcgacgag ccacttcctc gccagttagc atgccactct cgcgcaaccg ttcgaaccgg 301081
gtcttcagcc cataggctcg gcgaacgagc atgactttct tcaacgtaaa agcctcaccg 301141
cgccagttac gatgcccgag tgcgttgaga cgactggcaa tctgctggtc gttgtcggtc 301201
tccagaagtt tgttgatcag tgccacaacc gcttccgggg tcttgcggat cacggccatg 301261
ggccggggac gagctactgc caggctttgc gtgcgacctc cgcaatgttg atctgctcgt 301321
cgaccagcag tgtcacgtct tcgatgagga ggccaagcat gcgtttacgc tcgaccgcgc 301381
tggtgcgctc gttgttccag atgcgcggaa aatctgcggc cagcgctcgg atccgttcct 301441
gcatagcgcc gtccagcaat gactggtctg tctcgttctg acggtcatgt tcgcgctgaa 301501
gcgtatcgag gtcgcgtagc ttgccattcc aatccgcttc gagtgcgtcg gcaaccaagc 301561
ggttgtcggg atcgaccttc agatagcggc ggcgtgcgag ttcagcctca taccgggcgc 301621
gctgtaactg cttgtcgcgc agcgaggcag cttgttcgac acgttgtgag atctcctcct 301681
gcaccgcaag cgcgacctct atcgccgtcg gtgccatttg cttcgagcag caacgcgctg

Figure 3 (Cont.)

accgcttcat cgatcgctgg tcctcttgcc cattggcaag ccttgcccgc gtggcgcacg 301801
acggcctcgt tgcagatgta atagggacga agcttgccct cgaactgttc ataatggacc 301861
cgcatgcggg cgccgcagcg accgcacaaa actcttcctt gcaataagcc gttgccctga 301921
cgaggcatac gaccccgcag gcccggagaa aaaccgactg cattttgttc gagacttgtt 301981
tgattgcgtt cgaactcgtc ccacgagatg tagccttcat gggcctgagg gatgagcacc 302041
tgccagtcgg acctcggcat cttctgctgt acggacttaa gcttggcatt gtagatcgtg 302101
cgtgtgcgtc cgtatgcgaa agcaccagcg tatcgtggat tgtgcaaaat ctggatcacg 302161
cgagaatggt cgatctggct ccacaggacg tcgcccttgc cgatgccgcg acggatacga 302221
cggggaaaca ggatcttctc gctgcgcagg cggcgcacga ccgcacaggc tgagcccacc 302281
tcccggaagg tatcgaacag catgcgcacc gtgtcctgga tctggcgatc cggatcgagc 302341
accacgcgca tatcaggcgt gtagaccagt ccgatcggca acggtaactc gagctcgcca 302401
cgacgcgcct tgttgagaat gccgccttgc agtcgagact tcaggatgtg gagttcggcc 302461
tcactcatcg tgcccttcag gccgagcagc atacgatcgt tgaacgacgc ggcgtcgtaa 302521
acgccatctt cgtccatgat gagcgtgcgc gacatggcgg ccagttccag aaggcgatgc 302581
cagtcagcat tgttgcgagc caggcgagat acctccagcc ccagcacgat ccctgcgtgc

Figure 3 (Cont.)

302641
cccatcgcga cctccgtcac caagcgctga aatccatcgc ggtcctgcga ctgtgcgccg 302701
gaaaggccga ggtcgttgtc gatgacgtgg acgcgctcaa tcggccaccc cagagccacc 302761
gcgcggtccc gtaatgcata ttgtcgcttc gtgctctcgg tgttctcgaa cacctgacga 302821
agggaggatt ggcggacgta gagaaatgca tcgcgccgca ggtgatcggc gctaatcttc 302881
atggcattat cagtagacat ggcttcctgt ctctgctgcc agcaccatat tggcgagcat 302941
gtgcacgagc tggcggtcgt gcgcgaccat tgaagttgtc ttgaaccgag gcgctgactg 303001
ctgtcgcgct attgcggatt gatgtggtgc gatcagcact gccaggccgc gccacagtcc 303061
gtgaaagacg atggcgccca tgcgcctcgc gcaagccgtg ccgcaaataa catcggcgcg 303121
gagcgcttcg taaacatcct tgccgttctc tgacatggcg attgcgtggg tcggctcttc 303181
atcgtttttt tttccgcgcc accgcgcgtt cgatgctgcg aggatggacg ctgatgccca 303241
gtctcgaatg caccaggtcc gccagagaac gggcctgcag ttggccgttc gcgtcgagat 303301
gctcctcgac gagacgcatg acctcgccag taagcttgtg ggctgacttc ggcccacggg 303361
tgcgcggcaa gaggccggac atgccatcgc gctcgaacgc ggcctccgct tgatagtagg 303421
tctgccgaga aagcccaaaa agcgcggccg catccgcttt gttggtgccg tcttcgcggg

Figure 3 (Cont.)

303481
cgtgccgaag catctcatac ttcacttgca cgagatcgag cggatcaaag aaacctgctt 303541
cccggaacca gggggcgcgg acgctctcgg gcttggggtt cagagcgccc atctggcgca 303601
ggcgatcggg cttgctttct ttggtcatgg gagcctcctt gtgtaagata aattatgccg 303661
cacttggctc gcacgtcaat taaattatat cgctaatatc gccgatacgc atgcatcaca 303721
gggcttcact ccttgctttg atgatcaaag acatcgtacg cccggcataa ttagccttac 303781
atgtgcggcg tagtttactt gacgcttcgt cactcttcct gacggcgctt aatgcgatcg 303841
atcaacgacg ccagcgccga cagatcgtct gggcgggaga aggaccgacc tgcagcaacc 303901
tgactgaaca agtcggcctc attaacatcg gtccacgagg ccggcagcga acgcaaccgt 303961
ccttgagcgt cgtaaaacat gacgcggtct tcgccccagt tctgtttgcg tgtcgacagc 304021
acgaagcgct gtccgcgcca aggatggaac gggtgtgtga cctcgaactc tatgcgggct 304081
tgagtgtcag tacgaactgc agtcctggac ttgaaagaag gcgaagctcg agaacgccgt 304141
gcgctttgcc cagagctgca ttctcggacg cctccgcaag cagaccttct tctcgctcgc 304201
cgaggctaat gccgcgatcg ccgaggcgct cgcgcgcatc aacgatcatg tcatgcgccg 304261
gctcggcgtc agccgccggc acctcttcga gacggtcgaa cgcccggcac tcgcaagcct

```
         gcccgccgaa gactacgagt tcgccgaatg gcgcttggcg cgggtctcga cggattacca
304381
         tgtcgagtgc aagagcttct tctattccgt cccgcatgcc ctcatccgcc agcaaaaagg
304441
         cgctgaaaag tgatgcgata agcgcccttt acgaaggatg atcgatcagc cgtttcaatg
304501
         tcgtcaagat cgaagagacg ctgacgatcg aaaagttttt cccagctacg ccgcacacga
304561
         gcgctcctat gttcggatcc gttgctcccc gttgctattc cgcgcaaccc atttcgcgcg
304621
         cccactcgat aagtgttcgg ctctcgcgga tgaatgcgca tctcagacgc tcgccttcta
304681
         ctccgcctgc cttgtccttg gtgattgaac ttcctcaaag ggcctgaccg ttacccaata
304741
         ttactcaatc gtagggctca tcggcgttga atgcgtcatg ggggtgccgt aagccatcat
304801
         acatggagcg agaggagaag gcggtcgagg gggccgcaga tgcttcagca aggaggagat
304861
         atgaaacgtc gtacattcac cgctgggctg gcggctttgc cgttcctcgg ctccagcctc
304921
         acccgcgcat tcgcgcaaga tgctgccgcc tcgctcccga aaacctattc ggggcagaag
304981
         atccgagcgc tggcctcgac cggtgctgcc ttcgaagcga tggctacggt cagccgagac
305041
         ttcaccgagg cgaccggcat cgccgtcgaa tacgtcaacc tgtcctataa cgagcagtac
305101
         cagaagctga tcctcgatct aaccagcggt gcggcgtctt tcgacgtctt caacttcgcc
305161
         tatcagtgga aattcgagat cgagccgtat tgcgccgatc ttgcgaatat tccgaaggaa
```

Figure 3 (Cont.)

305221
attcagggtg cgccagatct cgcgcttgac gactatccgc aacgagcact cgaaatctac 305281
ggccgtgcca acaacaagct catcggtctg ccgacactcg gcgatgtgac gctgttcgtc 305341
tggaacaagg aggcctacaa ggccgcgggg ttggatcctg acgccgcacc gaagacctgg 305401
gacgaagtcg tcgagcgcgg cgccaagctc gtcagcaacg gccaattcgg ctacgccatg 305461
ccggcgggca agggcattca aacgaccgtg acctggatca tggtgttcaa gtcgatgggc 305521
ggcgaatatt tcgatgcgtc cggcgccccg acctttgcca gcgaagccgg cgtcaagacg 305581
atgaaattcc tggtcgagaa gctggcggcg gtcagccctc ccggcaatct tgcctgggat 305641
ttcccggaga tgttcaacag cctgtcgacc ggtcagtcgg ggcagtcgat gatgtggccc 305701
ggagctttcg gcgatctgct caacccgaag aggtcccagg tccacgacaa aatcgggtgg 305761
tcgccgatgc cgcaagcttc actgttgggt ggctggtcga tgggcgtcaa cgatgcctct 305821
cggtcaaagg atgccgccaa gctttacgtg gcatggctca catctcccga catcgttcgc 305881
cgcatgggtc ttattggcgg ggctccggca cgcatctcgg cgctaaagga tccggagttg 305941
atcaagcagg ctccgaaccg accggctgtg cttgccggtc tgcagggcga cgtcgccgaa 306001
tatccgccga tcaaggaagc ggagcaggtc cacatcatga tctatgatga ggtgaatgcg

Figure 3 (Cont.)

306061
gcggtggcga agatcaagac gccggaacag gcggccagcg atcttcaggg caaggttgag 306121
tctttcatgc ggcgccgcgg ctatctcaaa acctgaggtc gcgctccgtg gggggcaggc 306181
gttcctcccc gtctgccccc cctttacaac ggcaaatctg caagtagttt acctgatgac 306241
aatctctcaa acagttccac ggggcgcagt ggcggttcgc cggcgtcgcc gcatccgcat 306301
cagcactgtg gtgtggttca cgatgcctgc tgcggcaatc atgttgctgg tgctcggcgt 306361
cccgctggtc tactcgttct actacagcct cactggctgg tctctcgtcg ttcccggcag 306421
cgatcaggac ttcatcggcc ttctcaatta taccgatgtc ttgaggagca gcgagttctg 306481
ggcggcgatc cgcgtgacgc tgatctatgc cgtggtcgcg gtctcgctgg aatgcgcgct 306541
cggcatcctc ttcgccgtgc ttttgaacct agaattcttc ggccgcggcc tctttcgctc 306601
gctgatgctg atcccgatgg tgatcacccc ggcggtcgtc ggcatcttct ggaagctgct 306661
ctatgagcag gattccggcg tcttcaacta tctgcttgga accctcggct tcgagccggt 306721
accgtggctg agcctcaccg tggcgctcgc ctccgtcatc atcgtggacg tgtggcagtc 306781
gacgccgttc ttcacgctga tcattctggc ggggctgcag tccctcgacc gcgacacggt 306841
gagcgccgcg caggcggacg gcgccaatgc gctccaggtc ttccgctacc tgacgctgcc

gcatctcgtc ccctatatca tgattgccgc ggcatttcgc attatcggcg tcatggccga 306961
cttcgacaag atcttcctgt tgacgctcgg tgggccgggc aatgtcacga cgacgctcag 307021
cgtctacgcc tacaacaccg gtttcaaggt cttcgatatc ggcagaacca cggcgatctc 307081
gtggatctat gtcgtcttcg ttctcgcgat cagcgcgccc ctgatctggc gcctgttccg 307141
cggcgcaagc gtcaaccgcc actaggggag gtgaggcatg gctatttcat ccaacaccag 307201
ccgcaccacc cgcaagctgc tctggaccct cttctggtgc gtgctcgcct tcgtctatct 307261
gtttccatac acctggatgg tgctgaccgg ctttcgtcat ggcgtcgaca cgatctcgat 307321
gccgccacgc ttcatcttcg agccgacgct cgccggcttc aagcacctgt tcgaggtgac 307381
cgggtttcag aaatacatca tcaacagtgc ggtggtgacg attgtcagcg tcgtgctggt 307441
gatcgcagtc tccgcgccgg cggcttacgc gcttgcgcat gtcaccaagc ggggcggtac 307501
tctcctggtg gcgatcctgg tcgcccgcat cattcccggc attgcgatcg gcgtgccggt 307561
ctacctgctg gcgacgcgcc tccaccagct cgatacctat caggcgctga tcatcatcaa 307621
tgtggccgtc aacattccct tcgcgatctg gctgatgcgc agcttcttca tggaggtgca 307681
tccgacgctc cgcgaggcgg cgatttcgga cggttgcagc gaatggcagg tcttcacaaa 307741
gatcatgatg ccgctggtgc ttggcgggat gctggcgacc gccgtgttcg tgttcatcgc

Figure 3 (Cont.)

307801
ggtgtggaac gaatttctat ttgctctcat cctgaccacc tccgttagcc cgacggcacc 307861
tttggcgatg ctcggcttta gaacccagta cggcgtgcag tgggacgctg tcggtgctgc 307921
ggcgttcctg gtgtcgacgc cggtcatcgc cttcgccttc ataatgcagc gctacctggt 307981
gcaaggcctg accatgggct ccgtcaagtg acaggcatgg ttggtacaat tcttcgcaga 308041
aaggccgagc agaatatgac tgatgtaact atccgcaatg tcaccaagcg ctatggcgct 308101
ctgaccgtca tccctcagct ttcgttcagg atcgaggacg gggagtttgt cgtgctggtc 308161
ggaccgtctg gctgcggcaa gtccacgctt ctgcgcatgc tggcgggact ggaggagatc 308221
tccggcggcg acctcctgat gggagccgac gtaatcaatg atcgccccgc caaggagcgg 308281
gacatggcga tcgtcttcca gaactatgcg ctatacccgc acatgacagt cgcggaaaac 308341
atgggctttg cgctgaaact gcgcaaacgc ccgcgggccg agatcgatga acgcgtcgac 308401
aaggcggcgg cgatcctcgg gctcggcaag ttgctggatc gttatccgcg cgcgctttcc 308461
ggtggccagc gacagcgcgt cgccatgggc cgtgcgatcg tgcgcgaccc gcaggtcttc 308521
ctgttcgacg agccgctgtc caatctcgat gccaagctaa gggtgcagat gcgggccgag 308581
atcaaggcgc ttcaccaaag gctgaagata actaccgtct acgtgacgca cgaccaaata

Figure 3 (Cont.)

308641
gaagccatga ccatggctga caagatcgta gtcatgaacg agggacgggt ggagcagatg 308701
ggcacgccgc tcgaacttta cgaccgcccg gccaatatct tcgtcgctgg ctttatcgga 308761
tcgccgtcga tgaacttcct gccggcgacg gtcgctgcga cgaacggccc tcttctgaag 308821
acgccggaag gcgtggcgct gccaatcgat ggtggtccga cgcttaccgg acgctcggag 308881
gtgacctatg gcattcgtcc ggagcacctg cagctcggcg agaccggtat tcctgcagag 308941
gtcgtggtcg tcgagccgac gggttccgaa acacagctct atgtcacggt cggagggcgc 309001
gaagtcgtcg ctgtcctgag ggaccgggtc gacgtgcggc cgggcgaaaa aatctggcta 309061
acaccaagga agggctgcgc ccacctcttc gacccgaaca ccggcgcacg gatcgcgggc 309121
tgattgcccg ctcacgtccc gccgaccgcg tctggaagtc gaaacagccc gagggaggtc 309181
tcatgcgcaa gctccgagaa ctcggcgagc atggcgtcgt tggcatgccg tgccgcgatc 309241
agtccgctga cgccgatcgc gacggcttcc tgcgccatgc cgaaactgtc gacgacggcg 309301
agcgtgctga agcccttggc gatcgcggtc cgcaagagat tcatctcggc ggtcacgccg 309361
tagccgaagt cctcgaggct ggcgcgcatt tctccgtcga tcgctgtcac gctcggaaag 309421
ttgaccactc tgtggcagcc ggcggtctcg agggctttga ggatgtcgac gtggcggcgg

aaaggatcaa gggcgaacac gcccgcaaaa acctggctct cgctcaaaac gcccttccgg 309541
agctcggaca agagacgttc gttggcgtca tggatcggga gcagcaccag gctgtcatag 309601
gcgctgccac ccaatccctc gcaggacggg caacaaagcg tcacggattg tagatgatcg 309661
ccgggaaggg cggcgagatc cgtcacgatc ggaatggagg gaagtgttga gggagagtgc 309721
attgtgtacc cgagaaacgt ttacccaatt ctacccaaat cggcggcctc agccaattga 309781
tttgctgtgg cgcgccacta ccgtttcttt gaggcgagga aagcccgctg aggaagggcc 309841
gggaggagaa agatgaatac agtttatgtg gtcgggacct gcgataccaa gggcggcgaa 309901
ctgcgctatc tccgcgatct tatccggcaa gcagggtgtg acgctgtcct ggtcgacgtt 309961
tccgtctcgg agttccacag ccaagctgcg gatgtcgacg ttcagccgtc ggaggtcgcg 310021
cgcttccatc cgaacccgcc gaagcccgag gatctcaagg accgcggcaa ggctgtcgcc 310081
gccatggcgc aagccctggt ggaatttatc cggtcacgac cggacgtcga cggcatcatt 310141
ggtgccggcg gtaccggcgg tacggcgctg atcgctcctg ccctgcgggc gctgccgatc 310201
ggcaccccga aggtgctcgt ttccaccgtc gcctcaggca atgtcgcccc ctatgtcggg 310261
ccgaccgata tcagcatgat gtactcggtc acggacgtct ccgggcttaa ccgcatctct 310321
cgggtggtcc tcgccaacgc cgcccattcc gtagccggca tggtcctcaa caaggttagc

Figure 3 (Cont.)

310381
gccgccaagg acgagaggcc ggccatcggc ctgacgatgt tcggtgtcac gaccccttgc 310441
gtccaggcgg tcacccgtgc gttggaggca gacttcgact gcttggtgtt tcatgccacc 310501
ggaaccggcg gccagtcctt cgagaagctc gccgattccg ccctgcttgt cggcgggatt 310561
gatgtctcca cgacggaggt ctgcgactat ctggtcggcg gcgtcttccc ctgtacggcc 310621
gatcgcttcg gtgccttcgc ccggaccaga ctgccctatg tcggctcctg cggtgcgctc 310681
gacatggtca atttcggggc gatggacaca gtgcccagcc gatttcgctc gcgccgtctg 310741
catgtccaca atccccaggt cacgctgatg cgcacgaccc ctgaggagtg caacaggatt 310801
ggcgaatgga tcgcggaacg gctgaacctc tgtgagggga cggtccgctt cctgatcccg 310861
gagctcggtg tctcggcgat cgatgcgccc ggtcagccct tccacgatcc tgaagcagat 310921
agcgcgctct tcgcagcgct cgagcgcacc cttcgccgga cgaccaagcg gcaactcatc 310981
cgcgttcccc ttcacatcaa tgatccgcaa tttgcggaac tccttgtcac caacttcaaa 311041
gaggcccttc gtgagcactg atactcttgt caagcgtccc actcgttctg agttgatcga 311101
ccgtttccat agtaagatcc gcgccggcga gccgatcatc ggcggcggcg ccggcacggg 311161
cctttcggcc aagagcgagg aagccggcga tatcgatctg atcgtgatct acaattccgg

Figure 3 (Cont.)

311221
ccgctatcgg atggccggcc gcggctcgct cgccgggctt ctcgcctacg gcaacgccaa 311281
ccagatcgtc gtcgacatgg cgagcgaggt tctgccggtc gtcaagcaca cgccggtgct 311341
tgccggtgtc aacggcacgg atccgttcgt cgtcatgccg accttcctgc gcgaactgaa 311401
ggagattggc tttgccggcg tgcagaactt cccgacggtt ggtcttatcg acgggctttt 311461
ccgtcagaac ctcgaagaga ccggcatgag ctatgcccaa gaggtcgcga tgatcgctga 311521
ggcgcacaac ctcgatctcc tgacgacgcc ttacgtgttc ggcccggatg atgccgtggc 311581
gatggcgaag gccggtgccg atattctcgt ctgccatatg ggctgacga ccggtggagc 311641
gattggcgcg caatcaggca aaacgatgga ggactgcgtc gccctcatca accagtgcat 311701
caaggcggcg cgggaaattc gcgacgacat catcatcctt tgccatggcg gcccgattgc 311761
caatcctgag gacgcgcgct tcattctcgg cgcctgcccc ggttgccacg gtttctatgg 311821
cgccagcagc atggagcggc tgccgaccga agaggcgatc aagtcgcaga cgctcgcctt 311881
caaagcgatc cgtcgcaagc cggcctgacc gtgagaaggg aaagcaagca gatgaccatc 311941
tttcgaagtg gagaccagcc gccgggttgg tgcgaactca ccgacttcga gttcgttgac 312001
ttgaccgatc aacccttgcc gattccgctt gccgccgaaa agcaacgtct gctcgtcacg

agcggatcgt gctgcgtgag gagcgccgag ggagcgcagg ttctgagtga aggccagttc 312121
ctcgacatgg atggggccaa tggtcccttc accgcggatg ccggagaagg ggccgcacaa 312181
gtgctcgttt tttatggcag atggggcaac gaactcggcg gatgcggggt gttcaagctc 312241
ggccccgaca ccccggttcc ggtcaggggg gatccggtta attatcccaa gtcgacgaac 312301
ttcgattcgc attatcacga ctgcgacgaa tactgggtaa ttatcgaggg ggcggggacg 312361
gtcgtcgtcg gctcacgcag cttcgaggtt gaggtcggcg attgcgtcgc catcggcatg 312421
gggcaccatc atgatctttc cgaagtgtgg tccgacgtga agggcgcata tttcgagacg 312481
acgctcgaag gcaggaagcg ctttggtcat ctttgggagc acacgcatgg gcctgccgat 312541
gtccgtcccg agcgggtttg atccgtcgcg tgcgccaagt cctgcctacc tggaggtgaa 312601
catcaatgac gtataaggtc ctgcatatcg gcgccggcgg tttcggagag cgttggtgcg 312661
acacgttcct gccgcagaac gtggcggacg ggacgatcga ggtggtcggc ctcgtggaca 312721
tcgatgccaa agcgctcgat atcggccgca agcatctcgg cttgaaggcc gaacagtgtt 312781
tcaccgcggc cgcacaagcc ttccagatgg tggatgccga cttttgcacc atcgtcattc 312841
cgccagctct gcacgagggg atcgtcgacc tcgcccttgc gcgcggcatg cacatcctgt 312901
ccgagaagcc gatcgccgac accatggagg cctccgtccg tatcgctgag aaagtgagga

Figure 3 (Cont.)

```
312961
agtccggctt aaacatgggc gtgacgatga gccaccggtt cgatcaggac aagtcgacgc

313021
tgagggcgct cgtcggtgcc gacgccatcg gccgtgtcaa tacggtatcg tgtcggtttg

313081
ccggagactt ccgcctctat gattcctggg ggcgctttcg ccacgaaatg atgcatccga

313141
tgcttatcga gggcgctgtc catcacttgg atatcatggc cgatctcgcc ggcgcaccct

313201
gcacgtcgat ctatgcccgc acgtggaagc cggaatgggc agattacaaa ggcgacacag

313261
atgccatagt cttgatggac tttgcgaacg gcgctcatgg ggtctatgaa gggtcttcgg

313321
cacaagccac gggtcttaac gattgggctt tcgaatatgt tcgggtggag ggggaaagcg

313381
gcacggctat cctcgaccat cgtgagatcg aggtatttca ccgttacccg atgcggcttc

313441
gacaagcgag ccggcaagga aaaggtcagc aagtgtcgct gctacccggc aggaagtggc

313501
agaatgccct gttgatcgag caattttgtc aatggctcga cagcggcccg ccgatggcaa

313561
ccaacgtttg ggaaaatctg cagtctgttg cgctcgtatt ctcagcgatc gaaagcgtcc

313621
ggctgggtca accggtgaaa gtgcaggaat tcctccagtc ctaccgagtg ggggcttcga

313681
tcgagtaacg ataagatgta ggttagcctc acaatggctg atccgatcgt tcatcctggg

313741
gttcatcgtc ccgaattctc cgctcccctc cacgcgagag cggagattat cgcgacactc
```

Figure 3 (Cont.)

313801
agggccgcgc ttggcaagcc aaacacgact ctcgttggtg ctgcgatcgg cacgggaatg 313861
gccgcccagg cagcctcgcg gggcggcgca gactttatcc ttgccctgaa tgcgggacgt 313921
ttgcgtagca tgggcgcccc ttctatcttt tccctgctcg cattgcgcaa gagcaacgac 313981
tttgtcctgg atttcgctca atcagagatt ctgcctttcg ttaaagttcc agtctttttc 314041
ggcgccagtg ctttcgatcc ccggtgttcg atagaagctg aactggaaag aattgcggat 314101
gctggttttg gcgcaattgt aaacttcccc acctccattt ttctcgatgg acggtttcga 314161
gccgatatcg agggagcagg gctggggttc cagcgtgagc ttgaaatgct tcgggccgct 314221
cagaaaagaa atatggcgac tctcgcctat gttcgaactg tggccgaggc tcagcaggcc 314281
gcgaccgccg gcgtggacat cataaatctc aatctcggct ggaacgtcgg agggactgtc 314341
ggaagccgca cagagctcag cctgaggcaa gcggctgagt atgcgaagat cattttccgt 314401
cagatacggg ccatctcgga ggatactctt tgtgtcctcg agggcggccc catcgtcagc 314461
cccgaccaaa tgtacgaggt atccgcactg tccaaggcag acggatacat cggcggctcc 314521
accatcgatc gggtgcctct cgaagcctcg atggagcaga ttacatcggc tttcaaatcc 314581
gtcggcacct tgcaaaagcg aattgatgaa ctggagcgcc agctcgagca tgtgcagcgc

gaatactcga tcgttggtcg gtcaccttcg atccagcaaa tcaagcaacg tatcgaaaag 314701
cttgccgctt ctagtctccc ggtcatgatt accggacaag ccggaaccgg caaaaaactt 314761
ctggcacggg gtattcatga agctgccaga cgttccggca gcaagctcat cagctcagaa 314821
gacgcaagtg gggaatcgct ttttggcttc gccccgagcg agggcggcag gaaggtgctt 314881
gggctactcc aataccatcc caaagcaacc ctgctgatcg agagcgtcga atgcctgtgc 314941
gtcgacgctc aggaacgtct gatagaagtc atcgagacag gcgcttatcg gcgcctgggc 315001
gacaacgaga gagggcggtt cgaaggccgc ctgatcctgg catcgacgcg gccgcttcct 315061
gagttgggct cgagcgggca gctgatacct gctcttgagt cgcgtctcgc gccgggtcac 315121
gtctttcttc cccctctatg cgatcgcctc gaagatcttc cactcctagc tgaacacttc 315181
ctacaagcgc tccgaaagga tcgtcgtagc cggaagctgt cggtggacca ctcggcctat 315241
cgagttctga tgacctatgg ctggccagaa aatattcgcg agctcagatc cgtgctcgaa 315301
acggccgcca tccgctgcga aggcgactgg atcaagtccg agcatctgcc gccgctcggt 315361
gacgcgaacg cggacgcgcc gcatccgcat ccgggggaag agcgggaatg gatcctggat 315421
gcgcttcagc gccatcggtt tcgccgcggt gaagccgccc gatatctcgg gatatctcga 315481
aagaccctat acaacaaaat gcgagtgtac ggtctcccgt tgcagccaag agaaagatcc

Figure 3 (Cont.)

```
315541
taggcgaggg cgccaaataa ctccaggtag cttgttcagc gactgcagcg ccgccgccga

315601
acgaccgcag ccggagcgcc cagaccggtt attggggtcg cgaggtagtg gggcgcctaa

315661
gctcaacaca agctcggacg tgcaggcctt cactaaagcg aaaagaagcc tctcgccgac

315721
tttcacagag gggggagcga cagcactgtt cgggggtaat tgaagcggcg gcggggaagt

315781
agcgaggtgg caacaccgtc agtcgctgtc cggctttagc ctcgcaagaa gtgctaagac

315841
ctcggcttga atgtctaggc aaagggcttc gtatttgagt accccttcct ccaggtacgg

315901
agtctctctc cggtgacgtt caatagcctc ggccgcgacg gcgtaggctt caaacaggcc

315961
atccaattca attcgcggct cctgatgtgc cgcagcagat ctctgtgacg aggcagggct

316021
agcgccagcc gagctctgcc gttgcgaacc agtgacattt cactcgatcc ccagcacggc

316081
cctcggcagc tcatccttga tcaggtacga gcaaattatg cggaggatcg catttttatg

316141
gtaaggtaac gctaaagcag gctaggtgtt ccgagtttga tggtgtggaa cggccctccg

316201
agccgtggct caacagcgat ctcaaggtgt cagcgaaagc atctgctttt gactgtccaa

316261
aggaagtgct gcgcctctca actcgccatc tgactttaaa tggatggcag gggtggccgg

316321
taacgggcat ctggtataga catggcgtca tgtcatgcca gacgcagctt ctcagcgcct
```

Figure 3 (Cont.)

```
316381
cggaggccgc cttaggagag gacttcctct ccgctctctc gacggatctg gacaattggg

316441
ctctgttcct cgatatcgat ggtactttgc ttgacctggc cgaaacgccg gacgccgtag

316501
ccgttccgcc ttcgctgcct gcaagtctcg atcacttgtc gaaaaaactc ggcggcgctt

316561
tggcactcgt gaccggtcgc ggccttgatt atgccgacca gcttttttcg ccggccaatt

316621
ttcccattgc gggccttcat ggtgccgagc gccgcgaccc ggatggccgt gtgcacaaag

316681
ccgcagagac ggcggatttt gagcgactga aggccgagct ggtcgccgct actgccagct

316741
gggcgggcgt tctgatcgag gacaaggggg cggcggtcgc tgcccattat cggcttgcgc

316801
cggatagaca actcgaactt gaacagctga tggagtgggc gttgtatcga gccggaccag

316861
actgggcaat ccagcacggc aagatggtcg tcgaaatccg tccagccaga gccaacaagg

316921
gcgatgcagt tgcggcattt ctcggccagc cgccctttgc cggcagacgc gcgatcgcga

316981
tcggcgacga tgtgaccgac gaagcgatgt ttcgcacggt caaccggctc ggcggccttt

317041
cgatccgcat cggaccgcct gtgcctgcga gcgaagcgct cggctccatc ccttctgccg

317101
aggccctgcg cggcatcatc gccgcattgg ccctcctgaa tatttgagca cctgacatat

317161
tttcttgcat gaaaggaatt cggcatgagc cgtctcgtca ttgtttccaa tcgcgtacct

```

gttccggaca agggtggcat tgcgccggcc ggtgggctgg cggtcgcgct gaaagtcgcc 317281
ctcgaagagc agggcggcgg catatggatg ggctggtcgg gaaagtcgag tggcgaggac 317341
gagccggcgc cgcttgcgca actgcagcag ggcaatatta cctatgcact gacggatctg 317401
accgataccg acgtagagga atactaccac ggcttcgcca accgcgttct ctggccgatt 317461
tgccactacc gccttgatct cgccgaatac ggtcgcaagg aaatggccgg gtatttccgc 317521
gtcaaccgct tcttcgccca tcgcctggcg ccgcttgtca aacccgatga cgtcatttgg 317581
gtgcacgact accccttgat tcctctcgcc gcggaactgc gtcagatggg cctggagaac 317641
cgcatcggct tcttcctcca cattccctgg ccgcctgcag acgtactctt cacgatgccc 317701
gttcacgagg agatcatgcg cggcctgtcg cactacgacg tcgtcggctt tcagaccgat 317761
catgaccttg agaacttcgc cagctgcctc aggcgggaag gcatcggcga cgcacttggc 317821
ggaggccgct tgagtgccta tggccgcata ttcaaaggcg gcgtctatgc aatcggcatc 317881
gagactgcgg ccttcgccga attcgccaaa aaggcatcga ccaacagcac ggtcaaaaag 317941
gcgcgtgaaa gcatcgagcg ccgcagcctc atcatcggtg tcgatcgcct cgattattcc 318001
aagggactga cgcagcgcat cgaagcgttt gagcgcttca tcctggccaa tccggcacag 318061
cgggggcgtg tcacctatct gcaaatcacg ccaaagtcgc gctccgaagt gccggaatat

Figure 3 (Cont.)

318121
gaagccatgc aacgcactgt tgccgaacag gccggcaggg tgaacggcgc gctcggcgcc 318181
gtcgattggg tgcctatgcg ctacatcaac cgctcggtgg gccgccgcgt tcttgcaggg 318241
ctttaccggc ttggcaaagt cggcctcgtg acgccgcttc gagacggcaa gaacctcgtc 318301
gcaaaggaat atgttgccgc gcaggatccg gacgatccgg gcgtgcttgt tctttcgcgc 318361
ttcgcgggcg ctgcccgcga gctacaggga gcacttcttg tcaatcccta cgacatagag 318421
ggcaccgcca acgccatggc gcgctcgctc agcatgccgc tggaagagcg gcaggaacgc 318481
tggacgacga tgatggatca attgctggaa cacgacgttt cgcgctggtg ccgggatttt 318541
ctcaatgatc tgacggcatc atcagatcga tgtggttagg gctccttcaa tcaaagatca 318601
tcatcgtgcc attaatgaag tccggcgacc ggctgcggcg ttatcgccat agccgcctgg 318661
ccgcatttgg atcgtcggca cgggattgag attccaccgg acccggtgtc caaacccgaa 318721
atcggctctc gctgcctccg aaccgcaccc gaatacacgg aattaccgtg cgcacctcgc 318781
acgcgatgcg actgttgttt cgagggtatc aaccgaattt cagactgacc gtcttgcgag 318841
cgccaggatc tagggtcagg acctattaat ttcgtttggg atgtgattca gagtctccat 318901
tgaaggaggt cctgatgggt gatttgtttc tgctaagcga gcgccaaatg gctcgcatct

Figure 3 (Cont.)

318961
ctccgcattt tccgctttct catggggttg cgcgtgtcga tgatcagcgc gtcgtcagtg 319021
gtatcgtcta tgtgatccgc aatggtctgc agtggaagga tgcaccttcg cagtatgggc 319081
cacataagac gctctacaac cgcttcattc gctggagccc ggctcggtgt gtttgacagg 319141
attttcgccg ctttcgccgg cgaaggcccc caacctgagc gcatcatgat cgacgcaaca 319201
catctgaagg cccaccgcac tgcggcaagc cttctaaaaa aggggatgtt ccccgtcgta 319261
tcgggcgcac caagggcgga ctgaactcga agctccatgc cgtctgcgac gaggacggcc 319321
ggccgatcat catgttgctc tctgaaggcc agatgagcga ccacaagggc gcccggatcg 319381
tgctcaacgc gttgcctaaa gccgattgcc tcatcgccga taagggctac gacagcacct 319441
ggttccgaga agagctcctc gcaaggggca tcgagccctg catcccgtcc tctaaaagcc 319501
ggaagaaacc gtacgtctac gacaaagacc tctatcgtcg cagacacaag gtcgagaacc 319561
ttttcgccaa gctcaaggat tggaggcgca tcgcaacacg ctatgaccga tgtgcccaca 319621
ccttcttctc tgcaatctgc atcgcagctt ctgtcatctt ctggctgtga ttaacgagtc 319681
ctgaccctag ctcaggtgcc gtccgtttct ttcccagacc caaagcgcgc gcaagctcgg 319741
aacgcttttg agcatagctt gaagcaacca tggggtaatc agccgggaga ccccatttct

ctcgatattg ctgcggcgtg aggccgtact tagccatcag gtgtcgcttc agcgatttga 319861
atttttacc gtcctccagg catatgatga agtctgcggt cactgacttc ttgatcggga 319921
cggcgggccg ctgttcttcg acggcagcct cctcagcctt gtctgcctga gaggtgctgc 319981
atagcgagag atacgtctgc tgaataagac tggccagatc ggcggcagga acgatattgc 320041
ggctcaggta ggccgagaca acccggcttg tcagctcaag attccgttgc ccgctggcta 320101
accgcggttg gttcaatgtt cttctcctgc atcttccgtc acttagatcc gtccgcgcaa 320161
tttgcagata tttcggtcag aaggaaggcc gacagggagc cggttgattt ttgccgagag 320221
tttttctttt tgacgcgttg gtttcaccga gatcattctc gtcgcgtaag caggccgctg 320281
ctcggaactt gaaccacggc cgagcaaacg gccatccggt cgaaaaaccc gcgtgacttt 320341
agatacgcaa agttcgaggc gacgctcgct ggtcgcattc ggcttttggc tgctctcgat 320401
gatcacgggc accctcacag tcaccgagtg cctatccgcc tcccagaacc atctgtgcgg 320461
attccgaggc aagccgcccc cgcattccga aatcattccg ccccccaatt ccgagaatta 320521
gtcgccccct gattccgaga tgatgccgcc ccctgaaagg ggtcgtttgt cggggtgtcc 320581
tgctggtgat accaacgagc ggtgatcatg accgatgcgc ccattcgcgg agtccgatgg 320641
acatgatctt ccacggctgg tcgacgagct tgttccatgc ggcgcagcaa tgggtgacga

Figure 3 (Cont.)

320701
tgtcgtcgta gtccttgaag atacggttgg agagccagtt gtcgcgcatg aactgccaga 320761
cgttttcgac tgggttgagt tccggtgagc gcggcggcag gaacatcaag gtgatgttgt 320821
ccggcacctt cagtttcggc gtcacgtgcc atccggcctg atcgaggatg agcaccgcat 320881
gggcgccgtc atcgacgctc cggccgatct cggcgaggtg ctcctgcatg gcctcggtat 320941
cgcaataggg caggaccagg cccgcgccct ttcccttccg cgggcagacg gccccgaaga 321001
tgtaggccca catatgtgga cggctcccgc ttgcaagtgt tttctgcaga tatttttgac 321061
cggatcgctt gcttccatat gtgcggcctt ttggtgtggt cgcacatgac cactggccaa 321121
gatgatttcc gcaacgcgta ttcctaacat ggtctcgacc tttagcggtc agtgggccta 321181
acggagtttc acgcgtcttg gatcgtccga tcgcatcatc tgctcttcgc ttgcaagttc 321241
acagcatcag ctcacacggt agcattttgt ctttgctcac cgtggtggct gaacttttat 321301
gatgtctgcg cttggccttc tgcctggcga tatgactcgc cgctcgtcat aagcttccac 321361
gcaatccgcg ccagcttgtt ggcgagcgct acggcaacca actttggcct tttccgctgc 321421
agcagcccca taagccatgc agaggcgtgc ctgctgcggc ctgttctgac ttgctgtaga 321481
agagatgtcg cgccaaccac caagatgctc cgcaacattt cgtcgccagc ccgggtaatg

Figure 3 (Cont.)

321541
acaccaagcc tgacctttcc ggcagttgaa tggtccttcg gcgtcagacc gatccatgct 321601
gcaaagtcgc ggcccgattt aaacattcga ggatccggtg tcttcatcaa gagaagggag 321661
gcgcctatcg ggccgacacc cgggatctcg gccaggcgtt tgctgcattc atcagcacga 321721
tgcaacttca tcaacttttc atcgagcgtt ttgatctggc aagctagctc gcggtattcc 321781
tgtccatgca gcgcgaagag atcctgcgcc agttccggta gggacgggtc agcggcaatg 321841
cgctccaata gcgcttcgat gcggcacatg cctttggccg caacgatgcc aaattccatg 321901
gcaaaaccgc gaatggcatt ggcgagctgt gtccgattgc ggatgagtct ctctcgcata 321961
ccgaccagca ttaacgccgc ctgctgatca gccgttttca ttggcacgaa gcgcatggtc 322021
gggcggctca ttgcctcaca caatgcttcc gcatccgcgg catcgttctt gccccgtttc 322081
acatacggct tggccagttg cggtgctatc aactttactt catggccgaa cgaacttaac 322141
agccgtgccc agtgatgtga cccaccgcac gcttcaagtg cgataatggt cggcggtgtt 322201
ttctcgaaga acttcaccat ttcccggcgc gacagcttct tacgaaggat tggctgctca 322261
accgcattca caccatgcaa ttggaagacg ctctttgacg tatccatacc aattcggata 322321
atctgttcca cggacggttt ccctcgattg agaacttcaa cgaactcatt ctggcacatt

cgatgccgtt gggagccgtc cacctcaaca tggtgcgctg atccaagggc gcggatggtc 322441
tggtgccacg acgcgcccat cggcgcgtga tcttgttctt ctggcctatg cgcgcttcgt 322501
cggcccacca gagttcgatg tccgtgcctt gcgggagccg gcttcggatt tccgccagag 322561
cggcggggaa gtctttttaa aagcgtctac ttccagctcg ttctgagcgt agtggcgtgg 322621
gcgagccgac agcttggcaa agccgagcgc cttcaactcg cggccgaccg tcgtctcgtc 322681
catcgagatg cggaattcct ggaatatcca ctgaaccagg tccttgcgcc gccaacggac 322741
aacaccgtgg atcgccggga tcgggccgct ctcgacgacc tttgcaagag cctggcgctg 322801
agcggcattc aacttcgctc ggccgccagg cgctttgcca ttcaccagtc catcggggcc 322861
gcgcgcgttg aaacgcagga cccaatcccg cacaatctgc agcgtcacgc tgccgatccg 322921
tgccgcatcc gagcgcgggc cgccgtcata gatcgcggca agagccagca accgccgggc 322981
ctgattggca tccttcgtct gccgtgcgag ctgtcgaaga gcagctccgt cgaaatcatc 323041
acgcaacaaa accgccgaac ccatcgcaaa cctcctgttt gcagcatgga ttcagattcg 323101
cgacaccttg ggaatcccat gagagtcaga aacggcgctc gttggtatga gacgttcctc 323161
ctttcagtgt cagaggggaa ggaacgggat gccagcggag agactaaaga tgcggcgtgt 323221
ccgcgaggtt ctgagataca gatttgagga aggccttggc cacaagtcga ttgcggtgcg

Figure 3 (Cont.)

323281
cgttggagcg gccccctcga ccgtgcgcga gacgttgcgc cgtttggagc gtgccggcct 323341
ttcctggccg ttgggcgacg atgtcagcga tgcggtgttg gaagcggctc tctataaagc 323401
tgccggcacg aagaccggtc atcgtcgcag cgttgaaccg gattgagcgc atgttcatcg 323461
cgagctgaaa cgcaagcatg tgacgctgca gatcctctgg gacgagtata tcggccttca 323521
tcccgatgga tatcgctaca gccgctactg cgatttgtat cgcgcctggg cactgaagct 323581
gccggtgacg atgcgccagg accatgcggc tggcgaaaag ctgttcgtcg actatgccgg 323641
cgacacggtc acagtggtca tcgacagatt gtcgggaaag acgcggcaag cgcacctgtt 323701
cgtggcagtg ctcggggcat cgaggctgtc attcgcccat gctcgctgga gtgaaacact 323761
tcccgactgg attgaatgcc acctgctggc gcttgaggcc tttggtggtg cgccggcgct 323821
gctggttccc gataacgcca aggtcgccgt catcaaggcc tgccattttg atccgcaggt 323881
caatcgcacc tatgccggca tggcagcgca ttacggaagc gctgttcttc cgacgcgacc 323941
gcgccggccg cgcgacaagg agcggacatc acgatgcacc ttgttggagt ggttgagcga 324001
caattaatct gggttgacgg ccaccatatc gactgccggc gcctttttcg agtctgacgt 324061
tgcccggcgg ttcgtacaag tatcgatggt tgctggcgta tcgatgacgc ttgagagtgc

Figure 3 (Cont.)

324121
ctttgcgccc gagttggtga acggtcgatt cgcatacgcc gagctgctgg gctacttcct 324181
cgccggtgag catgccgccc tcgcgcagcc gttcgtaccg gctcttcaaa ccataggtgc 324241
ggcgcacgag catgaccttc ttcggcgtga agggttcgcc gcgccagttg cgatgcccga 324301
gttcgttgag acgagcggcg atctgccggt cgttggtggc ctccagcagc tcgttgatca 324361
acgccacgac ctgtgccggc gtcttgcgta tcaccgacat aggccgaggt ctggccaccg 324421
acaggctctg cgtgcgcccg ccgcgccaac ggatgttgat gttgacctca tcgtcgacga 324481
gcagcgtcac gtcttcgatg agaaggccga gcatgcgctt gcgttcgacg gcaccggtgc 324541
gctcgtcgtt ccagatgcgc gggaaatcgg cggtcagcgc cctgatgcgc tgctgcgctg 324601
gctcgtccag cagcgagtgg tcggcctcgt tctggcgctc gtgctcgcgc tggagtgcgt 324661
cgaggtcgcg cagccgtgcg ttccagtcgg cttccagcgc gtcggcgacc aggcggttgt 324721
ccggatcgac cttcaggtag cgccggcggg ccagttcagc ctcatagcgg gcgcgttgca 324781
gctgcgtgcc gcgcagcgcc gcggcctgct ccacgcgctg ggtgatctcc tgctgcacgg 324841
caagcgcgac atcgatcgct gccggcgcca ttacctccag cagtagcgcg ctcaccgcct 324901
cgtcgaccgg agcaccgcgc acccattggc agtgtttgcc ggcgtgtcgc acgacggctt

cgttgcagac gtaatatggg cgcagccgcc cctcgaacgg ctcgtaatgg acccgcatgc 325021
gtgcaccgca gcggccgcac agcagccgtc cctgcaacag gccgctgccc tggcggggca 325081
tgcgtccacg caggccgggt gaaaaaccgg tggcgttctg ttccagggct gcctgattgc 325141
gttcgtattc ggcccaggaa atgtagccgt cgtgggcgtc gggaatcagt acctgccagt 325201
cggatctcgc cacgcgcagt tgcacgggct tcagcttggc attgtaggcg gtgcgcgtgc 325261
gtccataggc gaaggcgccg gcatagcgcg ggttgtgcaa gatctggagc acgcgggaat 325321
ggtcgatctc gttccacagg acgtcgccct tgccgatgcc gcgacggata cgccgcggaa 325381
agaggatctt ctcgccccgc aggcggcgca cgacggcgca ggccgagccg gtctggcgga 325441
aagtatcgaa caggagccgc accgtgtcct ggatctgtcg gtcgggatcg agcacgaccc 325501
gcgcgtcagg ggtgtagacc aacccgatcg gcagcggcat ctcgagttcg ccgcggcgcg 325561
ccttgttgag aatgccgcct tgcagccgcg acttcaggat gtgcagttcg gcctcgctca 325621
tcgtgccctt caggccgagc agcatgcggt cgttgaaata ggccggatca tagacgccgt 325681
cctcgtccat gatgagcgtg cgcgacaagg cggccagctc aaggagacgg tgccagtcgg 325741
cattgttgcg tgccaggcgc gacacttcca gccccagcac gatccctgca tgtcccatcg 325801
ccacttcgct caccaggtgc tggaagccgt cgcggtcctg cgactgcgcg ccggagaggc

Figure 3 (Cont.)

325861
cgaggtcgct atcgatgacg tggacacgtt cgatcggcca gcccagcgcc acggcgcgat 325921
cgcgcagggc gtattgccgc ttggtgctct cggtgttctc gaacacctga cgaagcgagg 325981
actgacgcac gtagaggaat gcatcacgcc gcagatggtc ggcgtcaacc tttatggcga 326041
tgtcagtaga catggttccc tcgggtctct gctgccagca ccatgttggc gagcatgtgc 326101
acgagctggc gatcgtgcac tgcgaccgaa gccgtaggcc gtgattccag ccgccgatgc 326161
gtcggcgggg gaggctgcgc gatcagcacc gccagccctt gccaaaggcc gtggaaaacg 326221
atggcgccca tgtccttggc gcaggcctga ccgcaaagga cggcggtgcg cagcgtctcg 326281
tagaaatcct tgcagctgcg cggtagcacc ggggtgcgtg catggggctc accgtttttt 326341
tttacgggcg atcgcgcgtt cgatgctgcg gggatggaca ctgatgccga gcgtcgaatg 326401
cagcagttct gccagggagc gcgcctgcag cggggcgccc gcatgctggt tctgctcgat 326461
gagctgcatg acctcgtcgg tgagtttgtg ggccgacttt ggccctcggg tgcgcggcag 326521
caggccggca atgccgtcgc gttcgaacgc ggcctcggcc tgatagtagg ttggccgcga 326581
cagaccgaaa agcgcggcgg catcggcctt gttgacgcca tcctcctgga cgtgacgcag 326641
catctcgtac ttcacctgca cgagatcgag aggatcgaag aaggtggact cacgaaacca

Figure 3 (Cont.)

326701
gggtgcacgg acggcttcgg gccgcgcatt gagtgctccg agctcgcgca gtcgctcacg 326761
tttggtctcg ttgggcatgg cataacctct tcctagtggt gtaaatcaaa ttacgcctcg 326821
atagagaacg tgtcaaccta acgacgccgg gcgatatggc tgtttatgct gcatataact 326881
acaatgtaga ggcaattatc gctgtgagcg cccgtatgat tcggcataat tagatttaca 326941
taatcggcat aaattgcctg acacgcattc agccgccatg gctgcgctcg atttgctcga 327001
tcaatgcggc tagggttgcc agatcatctg gacgcacgaa cgacctaccg gccgcgatct 327061
gaatgaaaac atcgggtgca gcgacgtccg tccatgacgc aagcagcgag cgaagccgcc 327121
catccgcgtc gtagaacatg acgcgatcct cgccccagtt ctgcttgcgt gtcgacaaca 327181
cgaagcgctg gccgcgccac ggatggaacg ggtgcgtgac ctcgaactct atacgcactt 327241
gagtgtcagt acgaactgca gtcctggact tgaaagaagg caaaagtcga agccgcggtt 327301
cgcattgtcg agcgctggct acttggccga ttgcgccacc gcgtctttta cagccttgcc 327361
gacgtcaatg cggcgattgg cgaattgctc gtcgatctca acgacacccg tgttctgcgc 327421
cgtgtcgggc gcacgcgacg ccagttgttt gaagagatcg accatcctgc tctccggccg 327481
ctgccctccg aacgctacgt ctttgccgaa tggcgcatac gccgggccgg cctcgattat

catgtcgata tcgacaaaca ttactactcc gtgccctacc gatttgcccg cgagcaggtc 327601
gaggcgcgca tcaccgccaa taccatcgag atcttccaca aaggtgagcg catcgctgcc 327661
caccgccgct cgagtggcaa tgggaagcac acgacaacac ccgaacacat gccatcatcg 327721
catcgccgct ttgccgactg gacgatagag cgcattagcc gcgaggcatc ggcaatcgga 327781
tcggatgttg ccttgctctg cgagcgtatt ctcgctgatc ggccgcatcc ggaacagggc 327841
ttccgggcct gcctgggcat tatccgcctc gtcaaagcct tcgagcgcga gagggtcaat 327901
gcggcctgcg gccgggcatt ggaaatcggc gcgcgaacct atggatcggt gcgctccatt 327961
ctcgacaaca atctcgatcg gtcgccagcg tcagccggca cagcctcgcc tgaacccatc 328021
caccactcca acatccgcgg tccacgctat taccactgag gagaagccat atgcttgcac 328081
atcccactct tgataaattg aacaccatgg gcctgaccgg catggccaag gcgttcagtg 328141
aactgatcag caacggcgaa agcgagcaac tctcccatgc cgaatggctc gggctgctgc 328201
tcgagcgaga atggagctgg cgctacgatc gcaagcttgc cgcacgtctc aggttcgcca 328261
agctgcgcca ccaggccgtg ccggaggatg tcgattatag aagtgaacgc ggtctcgatc 328321
gcgccctgtt catgaagctg atcggcggcg actggatcga tgcccacgac aatcttgcca 328381
tttgcgggcc gtccggcgtc ggcaaaagtt ggttggcctg cgcactcggg cacaaagcgt

Figure 3 (Cont.)

328441
gtcgtgatga tcgctcggtt ctctaccagc gcgttccgcg gctgtttgcc aaccttgctc 328501
tggctcgcgg cgatggccgt tatgcaaggc tgcagcgaac cctcgggcac gtgcagctcc 328561
tgatcctcga tgactggggc ctggagccgc tcaacgagca ggcgcgccac gatcttctgg 328621
agatcctcga agatcgttac ggacgccgct cgacgatcat taccagccag cttccggtat 328681
cagcctggca cgagatcatc ggcaatccaa cctatgccga tgccatcctc gaccgcctcg 328741
ttcacaatgc ccaccgcatc gacctatccg gcgaaagctt acggcgaaac cagcgccgga 328801
aatcttgact cgcgaccacg atcaactgac aacaatgaca gccagcagga ccccagcctc 328861
aaggggggcga gatcatcccg gaatccgggg gcgcaatcat ctcggaacaa aggggcggct 328921
tcatcggaat cggcaccatc tgatagaaaa gacgccgagg cggcgtgaaa cgcgaggcaa 328981
gaggtaaccc cgagatggca taggctgtct tcgtcaaata ttcgattgca acttccccgg 329041
ttgcctccta attaagccgc cagacgcctg tgccatcggc cgttggatta tattgttctt 329101
ttccagattt agcgggttac agcttttgtc cacagaccag aaccatttga ttttcttcat 329161
ggatgatttc ggaacacgta cggcttgcaa ggcgaccgaa actttgccca tgtggtcgca 329221
tgtattcagc ttcggcttgg gtggaatcat cgttccatcg gaggccgttc acgaaatctc

Figure 3 (Cont.)

329281
cagcgcgacc aatgaccttt gcgcaagatg ggatgtgccc gtgctgcacg gaaacaagat 329341
cagaggggcg cgagggagct ttggtttcct gaagaaagac gagaacaaga aagcgcggtt 329401
ctttcaagag ctggaagaaa tcctgatcga cgaccggatt accgcccatg cttgtgtcat 329461
ctgtcggcca ggctacagag accgctacca tgacaagcgc cctgagggtg tccgttggga 329521
gatgagccgg accgcattcg atatatccgt cgaaagggct gccaaatatg cccgttctct 329581
caagcgtaag ctttcggtgg tctatgaacg aacaggagaa accgaggatc gattgattga 329641
aggttacttc cagagattgc ggacaaccgg gacagagttc agcgttgaaa actccgctca 329701
acacagtccc atgtcatctg ccgatttggc tgacacattg atgtcgatct ggccagacgg 329761
caagggaaac ccgatgctgc aattggcaga cttggtggtc catccattgg ggcatcgccc 329821
aacgggtctt aggaatagag catatgaccg cttcgcagag tcaggccaac ttctagactc 329881
tcgcaccgat gatccgacga tctcgattaa gtattcgtgc tacgacgatc cgtacaagga 329941
atacgtggct cctgaaggaa accccagaaa cacataaggg acccgaaggt cccttatggc 330001
ggttagcgta aaagcaataa ccccgtggca aagccatacc ataaggtaga taagtcctgt 330061
gccatttgca aggcgtttgt gaattttagc caaaaatcgc tatctccttg aattgtggtt

ttaaagactc ttgaacggct tcacaggccg acggtaagaa gcgcgtgttg tcgatggctt 330181
tcgccctgag gcgttctcca cgcgcggtgc gcctcaagac agtccctgcc gttcgaaaaa 330241
atgaaagcgg gcggccgttc gatatccggc tatcgttcta ccgtccgcag gcactttggt 330301
ttccaaccag tgcctttcgc gcccgacaac gtcgccggag ggcatactga tcagggcatt 330361
aggcgcaggt agtatggtga ttcgctcggt gggccgaagt ggccaaaaac ctgcgcgatt 330421
gttgcctgcg tatgctcgtg aaacaggttc agcgacgccg agagcagcgt cgaggatggc 330481
gcagctcagg gctaccagct tcgaccaccg taaggcaagc taatattagg tggattgctg 330541
cgcggtcgca ttgaaccagg gttagacaat tgaatgcaat cggttcccgg tattggctaa 330601
ggtagattct gattggcttc gccaggttga cgcccgttgc gcggtcgcca gccgcatcag 330661
cgcaaactga cgcaagggca ctgggcaaat ccccatctga cctcggtata gtcgatgttg 330721
acgttgacgt attgcgtcga ggggcaagag gatttcagct caaggaagtg ctctttgaac 330781
tcgatctgcc gcagaacgat tgctccgtat tcgtaatatc cgcctgcccc attttcgaga 330841
aggtaacttt ggtaggtgca tgtcagtgcc ttgtattgcg gcggcttgcc attgccgctg 330901
aaggtgaggt tgcccatctc ggtgaggaag atctggaaat ccatcagcag cgatgcgcca 330961
tctgtgatga ttgcgttggc aagcaaggag agaaaggtgg ctgcgacaga ggtgccggca

Figure 3 (Cont.)

331021
aacctgttgc aaaactcttc tgcttgtgtc tgccgatcga aacgtcgggg atgttggcaa 331081
caacgtctgt ccaggtgttg atgtccagtt tttgtgaatc gatgatggaa taatgggtgt 331141
gcgcgtagtc gtgaatgagt cctcctatcg ccagcaggtt gtcctggttc tcattcataa 331201
tgccgttata gatcggatcg ttcgttttct ggccgatgag gtgaaactgt actgcccctt 331261
gatcgttcgc gatcgtgtcg tcactggggg gcgcagcatt tctctgggcc aaaaccaggg 331321
gcttgcggca gaaaagcgct ctcgccgcct cgtagttctt gtctgaatag ccctgtttat 331381
gctcgtgagt atccactgca attgcgttcg acatgctttt cctcgtgggg agatctgagc 331441
gttactgtaa gatccgtgag gtgccctgaa cgcgcaaagc ctgagtgcga gaacattttg 331501
ggcgtctgtt gatgtatacc aggtcattcc ggtctccacc tttgcgtcag gcaggctttt 331561
ctctgcccgc gaccattttt gcgatagcgt agcggcgaga ggccatgaaa cgccctgaaa 331621
gctgtcgaga agttgttgct gttgtcgtac cctagtgact ctgcgacggc ggcgacgctt 331681
tcgtggccgc ttcgcaggcg cgcggcagcc atggtcatcc ggtagtgccg taaccaagtc 331741
atggggcgca gttaaaggat gcagcaaagc gcttattggt gccgatgatg cgagccaatt 331801
tgctgagggt gatcttctgg tcgacctgct gtgcaagcag gtcgcatgag tcctgcacca

Figure 3 (Cont.)

331861
tgggatcagc tgagaagaat ggcggagcag aacgccgagc gatctcggcg gcgcaggcgg 331921
taagtctgct cagaacttcc tgctcgatag gcggtcacag cagttagtca aagtacccgt 331981
tggagtaaac tgcccttcga tacaggctgc cttccgcaac caaggctagt tgcacgagtt 332041
cggatgagag ctccgtacga tcgtgattgt tttgcggggc gcgacaatcc acgatgacga 332101
gttccgccga gcgtcctggc cgcaacaaac ggtaatcaac gatatcgacc ttcggcagag 332161
agctcgcgat ttgggccaac gacgtacatg tgaccaggtc ggacccaagg tacgctccca 332221
gaatggatgc atgcaccttt ggcccaccct gaggatatgg cctaccaatt ggcttggtgc 332281
ggcgcacggc agttgacgag gggagacttg gattgtgtag atggccgaac gtgtgaatac 332341
gcgctcgttt ggcagtttgc cgaaaaccct cgattcaaat tccggctcgc gataggctcg 332401
catcgagctc gttgtattgg cgcagcggcg tcttcgccgg ccggcgcatg aggagagggt 332461
aaccaaccgt cgccgatatg gaccgaaggc ggccagattt cggactcatt gcctggacgc 332521
agcatcggtc gactgccctt gctctgttgc cgttgccgcg gcggcgatct cctggcgcaa 332581
ccaccgatgg tccgggtcgc gatggcaacg ctcgtgccag atcagcgcga cctcgtaggg 332641
cggcagttcc acaggcgggt cgacaatcac tagcggcagc aaggcggcgt tcctggtcgc

gacgcggcgt ggtacgacca gcaccagatc ggtcgacacg atcgccaatc cggccgtcag 332761
gacattggaa accagcaccg gatcgggatc ctggagatcc aacttgacca gatcatcatg 332821
cacccggccg aaaccgtctt tggtatccga ggcaatggcg gcgtggcgca gggctgagaa 332881
ggtgtcgatt atcgattcct gctccagggc tgggtggccg ttgcgtagca ggcaagcaaa 332941
gcggtcgttg tagagcctgc gccgaaagta gcccggtgga gcctcaccga tctggccaac 333001
ggctaaatca atttcgcctt gctcaaggcg tcggagcgct aggagcgaat cggtcactat 333061
gtccaggtta ggcgcgcgct cgcgcatcag cggcaggaaa ggcggtagca gcacgatcgc 333121
ttgatgatca ggcattgcca ttcttgccgt taatcgccat tctccctgat caaggccggg 333181
gtccaccatc ccgcggatcg aatccaacac cggcggtagc atctggccca ggcgttgggc 333241
gtgaggcgtc ggaaccatgc cgcttgagcc gcgaaccaac agatcatcat tgaaaacgcc 333301
acgcagcctg atcaaggccc ggcttaccga cggttggctc aggcccaggt gccgggctgc 333361
ctgcgtcacg ttgcggtgct cgagcagcgc ctcgagagcc aacagcgtgt tcaggtcaag 333421
cgatgccaac atttgccgtc gccgtgcggc gcgagggccg gcgacgatca gttgcggccg 333481
ctgccattcg ttcgaggtgc cattacaagc gggctcatcc acgagcctct ccttctgtct 333541
tcgtacgcag tgtgctcagg ctaacgtctc ggagaactgg cggtgcggag tagcccgagc

Figure 3 (Cont.)

333601
atgctgagca catcaggggt ttctccagcc ggatcgacat cgtcaaaaca cggcgtcgat 333661
tagagaggtg ataactggtc aaacgctcga cccttcagtg ccggcgacga gcgcatttct 333721
gacgtttggc cggttaccgc tcgacgctgt tggaggcgat ctcttcgggc cggcgactga 333781
gccggcgcat ttgagaatgc ggagaggatc gcctcaacga gcttgattat ctggcgcaac 333841
ccgtgagttc tccccgcggt ctgcgccatc gccttacttc gtcagccggg aaactggtct 333901
gtcttcgcct tcgtgctgtg accgcgacac attcaccata cttccgcaag acagattgct 333961
ggctgattta ttttacccag tcgcggtcag cctgcaactg gcgcggccgc gtccaacggc 334021
gccgccaaac ctcggggtgg atccaggctt gcgaggaagt cgtggcacca gcgatagaca 334081
tcgtgctcac gaagcctctc catcatcgcg gtccatcgtc taatccgctc atctcgcggc 334141
atgtccacgg ccgtttctat ggcgcttgcc atgtcctccg ggtcataggg attgacgagg 334201
atcgctcctt ccaactcact ggaggcaccg gcaaagcgcg agagcacgag aacgcccggg 334261
tcccggggat cctgcgcagc gacatattcc ttcgccacca ggttcatgcc gtcgcgaagt 334321
ggcgtcacaa gaccgacgcg tgccctgcgg tagacgcgcg ccagttccgc ttggctgagc 334381
gactgattga tgtagtgcac cggcacccac ccaatggttc cgagttcccc atcgacgcgc

Figure 3 (Cont.)

334441
cccaccagct cggcgacgtc cttttgcacc gtctgatatg ccggtatttt gtcgcgggat 334501
ttcggggtga tctgcagcag cactgtcttg cgcctgcgat gtttgttgcg ctgtaggaat 334561
cgattgaagg cgtcgatgcg gttctcgatg cccttggaat aatcaagacg atcgacgccg 334621
atggcgacgt caaatccagc aagcctgcaa aagcgatcct gcagatcgtc gtcgcggtct 334681
gcgagacatg cgaactcggc cgtatcgatg ctgattggaa atacgccgca gcgaaattct 334741
tttccatagg ctcggcagtc atctccgttg agatccccca ctttctgccg gagcaggcat 334801
ttggcgaagt tgtagcgatc gttttcggta tgaaagccga cgaggtcata acacgaaagc 334861
ccgcgcagca ggttatcata gctcggcagg gtgaagagga tgtcggccgg cggccacgga 334921
gtgtgcagga aaaagccgat ccggtttttg tggccacgct gttgcaattt ctcagcaagc 334981
gggatcaggt gatagtcttg cacgggactg tcaggaattc tgtgcggggg gccatgatga 335041
tgaaaaggag cgaatcatca catggctatc gaaaaagaac ttctggacca gcttctcgcc 335101
ggtcgtgatc catccgaggt tttcggcaag gacgggttgc tggacgatct gaagaaagcg 335161
ctctcggagc gcatcttaaa tgcggagctc gacgagcatc ttgacgtcga gcgtagcgag 335221
ggaacagccg ccaaccgccg caatggctct tcgaagaaga cggttttgac tgggacgtcg

aaaatgacgc tcaccatccc gcgcgatcgg gccggcacgt tcgacccgaa actgatcgcg 335341
agatatcagc gccgctttcc cgatttcgac gacaagatca tttccatgta tgcccgcggc 335401
atgacggtgc gcgagatcca gggccatctc gaagacatct acggcatcga cgtgtcgccg 335461
gacctgattt cggcggtgac agaccaggtt ctggaagccg ttggggaatg gcagaatagg 335521
ccgctcgagc tttgctatcc actcgtgttc ttcgatgcca tccgggtcaa gatccgggac 335581
gaaggtttcg ttcgcaacaa ggcggtctat gttgcgctcg ccgttctggc ggacggtacc 335641
aaggaaatcc tcgggctctg gatcgagcag acggaagggg caaagttctg gcttcgggtg 335701
atgaacgaac tgaagagccg cggctgccag gacatcctga tcgccgtggt cgacggcctg 335761
aagggtttcc ccgatgccat caccgccgtc tttccccaaa cgatcgtgca gacctgcatt 335821
gtccatctga tccggcattc cctggaattc gtgtcctaca aggatagaaa gcccgtcgtg 335881
ccggcgttga gagccattta ccgtgctcgg gatgcggagg ccggcctgaa ggcgctggag 335941
gccttcgagg agggttattg gggtcagaaa taccctgcca tctctcagag ctggcggcgc 336001
aattgggaac acgtcgttcc cttcttcgct ttcccggaag gcgtccgccg catcatttat 336061
accacgaacg ccatagaggc cttgaactcg aagcttcgcc gagctgtgcg ctcgcgcggc 336121
catttccctg gtgacgaagc cgcgatgaag ctgttatatc tggttctcaa taacgccgcc

Figure 3 (Cont.)

336181
gagcaatgga agcgcgcgcc gcgggaatgg gttgaggcaa agacacagtt tgccgttatc 336241
ttcggcgaac ggttcttcaa ctgatcaaac cggccccccg cacagaattc ctgacagtcc 336301
cgtcttgcac ccatatgacg tcgtcctccc ggagggcctg ctccaacaga tctgcgaaaa 336361
gttcgttgac gcggtaatat gcggactccc gcgtctcgga atattcagcg aggtcggcac 336421
ggttgtggaa gatcggccaa agaacctggt tggcgaagcc atagtagaat tcttccagat 336481
ccgtctgcga gagatcggta agcgcgtaag tgatgccgcc gacgtccttt ctgatcaacg 336541
ctgacggttc ttcctcggct gcgaccttgc ccgaccatcc catccagaca ccgccctttc 336601
gccggagtgc ggcgttcaat gcaaccgcca tccccccggc cgacgacgag ccgggcaggg 336661
taaccctgtt agacacgacg atcagtctac tcatttcgac ctcccgtcgt cgcacacgcc 336721
ggcctatcca tgcgaacgcg gctctccagt tgttcagaag ttgctggcca gggtagctca 336781
ttctgcgcga ccacggcagc catgtgcgta agcatataca catcagtatc tcgtattgag 336841
agaagatgtt ttgatgatgg taacaatagc ttcattagta gacttttcag atgtaggtta 336901
gttggcatgt caactaataa tagtactgat agtttgcata gtaaggctcg caaaatgcac 336961
ggctccgtca acttttccca ggtttcaagt gaaataaagc tgagccggat tagtatgttt

Figure 3 (Cont.)

337021
caaaaaacag caatcaagcg tgcacagatg ccaacgatgg ggctaaagga gcggaggcaa 337081
acgagactcg taggaagagg gtctcccaca atgttggtgt accgcaccag caatactcta 337141
cgttaaatca gcagaacgcg accgccgaag accagcggcc ttcgagagct cagttcccgc 337201
gcaacagcag aacgctccgc atagccctat ttgtctgcgc tattctgcta tgcacctgat 337261
gatgattgcc ccactcggtg gccgtcctca ttttgggagt gatggcccag gaggccaaag 337321
ctacagcagg agtgactatg aaaaacattc tcgttatcag tcaggacgct tcgatgaggt 337381
aactgctgat ggagttcttg ccaaagcatg cgtttagcgt cagagcggtg gaaaacggcc 337441
agcaggccgg tagcaagatg gcttccgagg tgattgatct agcaattatt gatatgagcc 337501
tccgccgaga agatggtcat tggctcgtcg gggattttgg cgcaaagata gaccttccaa 337561
tcatcatcat cagcggtgac gaccttgaag agggtgacaa catcagccga ctccacaccg 337621
gcgccctcga ctgtatctcc aagcccttcg gcttgccgga gctcctgacc cgcgtgagcg 337681
ccgctttacg cgatcggcca gagcgtcatc ggaacaggat cttccatttc gatgactggc 337741
gcgtcagcac gaagcgtcgc cgtttgcgcc gagggaccaa tggtgaagtc aagctcactg 337801
cgggcgaatt caacctcctg atggcctttc tcaacaatcc gggcaggtcc tttcgcgcga

gcagcttttg gtggcgacgc acgtctatga tcaagaggtc tttgaccgca gcatcgatgt 337921
taaaatcctg cgccttcgcc gcaagctagg tcagcacacc ggctcgaacc cgcaatatat 337981
tcgcacggaa aggggcgcag gctatgtttt cgacagcgtc gtgaacgttg acgagttgag 338041
gacgcgcggc cactgacagc gcactcattc tattttgctt gaaggtcgca tgttcgcctc 338101
agggcggttg gggcgctgga tttccatcaa atcctctcgt cagatgaacg agagctactc 338161
caaccaagtg tctcttctgg gtgttgcagt ggcgctccgt gtcttaacga cggaccagaa 338221
tgccccggtt taaaaggctc caagcggcgg tccggcgctg gagctctcga cgttgccggc 338281
cgtcaagacc gtaaagccgg cggactgcca ggcgacttca ttaaaagtcg cttgtagaga 338341
cccacagtcc atgttgagaa ggggagatat tcgccggccg cacgctcaat tgtcctcgcg 338401
gcgacgaccg gcgaatgtgc aagagaattc gattgcgcat gacgccggtc ccgaggctgt 338461
cgaagcgaag ctgaagacac gttggcactc ccgtccgata atccaacgca agcgtttagc 338521
acacctgagc cggcgtcaac gacgccggag cgagcttgct gcaccacgcc attcgccggg 338581
ggctgaatgc ttgcataagt gagtggcggc agggcgaaag ctgcgcgagg aattcacgag 338641
attgagtggc aagctgctgt cggtcgtgcg cgacgatcag tttgccggcg gatgggctgg 338701
gcctcgatga tggcgcagat gcagaacatt atcgacttcc cgcccgcgcc caagctggac

Figure 3 (Cont.)

338761
gcgtctggac gccaagccgg gcgagcgagc agcagcgaga gggcgaacgg gtgtttatga 338821
gagtccgctg caccgttcgc cacgcccccg cagaccgcct tcatgtgcaa caacatgcac 338881
gacccgaagc tcgggcgctt ctctaatatc agcccgacgg ccaacgatct cgtgatgtta 338941
ccaggtggtc caaccaaaac cttcacaccg cgacgctgcg tggcatcaag gacgctccac 339001
cctacttgca cgatgggcgg ctgataacac tcgccgacac ggtagagttc agctaggtct 339061
tgtaggtgga gatcgtggcc gcggtggttt ccaccctttc gaagagaagc gcccgacgtg 339121
ttaattgtcc gatccaggca tgaggcagcc agttctcggg tccgccacat aggaggatca 339181
tgactggtct gggcgctcgc gcttctggag agcggatgat cgttctgagg cagcgacggt 339241
cggtccagct tggttcgccg ctctgagcgt tcggatgcgt gtgccagtcg ccaatgtagg 339301
tgtctacacg gcctgacacg cgataatgac ggtcgatctc ggattgctcc cattcacggt 339361
ccggggaaaa gcttttgcgt gtgcggatcg cttccgatcc gccgtcaatc atcttcgtga 339421
ttaccgcgac attcgcgtcc gaccagtatc ccataaaggt cccgcctgtt tcgaggtcgt 339481
gccaacggct cgcgtctttc agcatcgctt cgacgacgga ctccggtatc caaatcagct 339541
tcggcatccg cagtccgggt gtcgttccag tggatcgatc cgccaactcg gcggcatacg

Figure 3 (Cont.)

339601
acgttttacg ttatgcagat tgactgtgcg gacctcggat accgtccact catccgggct 339661
agacaggaca tcgacggcca tccggacggt ctccaaggac agttccttca ggtcgaatga 339721
agctccggtg aaggtgagct cggagcaacc gggtggctga acgagcgttg attcgtcatt 339781
catgccgttc ggatagggga tgtgccccga ctttccttcc ggggtctcgt tggcgtgcgc 339841
catgcacacc ggacaaccgg attccggatg atggaatacg accgccccgc catgcaggtt 339901
gggtgaggcg aaaacggaga tgagcgaaag gccacgctcc cggcagatgt cgccgagaag 339961
gtaggtaacg cccggcgcgg cactggcgtc cacaacgaga tcgacgctgt ctaataactc 340021
gttcagccga tctgtttctc cgggaatgtg cggatcgcag tttggtaatc caatgcggtg 340081
cgggacggcc agaacggacg tccatggaaa ttcccgttcg atgaaccgct tcaaggcgtc 340141
ctgcttcttc gttccccaac tactggctcc aagttcccaa cggatcgtgt tgcccggttc 340201
gacgacgtcg tcgtccatca ggtggagcga ggtgcagccg tttctagcca gttcgacggc 340261
agcgggtgat cccagcgccc cgagcccgac aaccgcaatg cgtttgcctc tcagactcgc 340321
gaccgatgga actcgatagc cgatgtctat ctcgccgtcc cgaaaaacag gcacgatgga 340381
cgggaccgtg tctttacgtc gtggtcccct acgacttgag tgtgaaatgt gctctcttac

cgccattccg cacacccaag catctccatg ctcgttgtgt tgaagttcgg tcctgctgat 340501
cgtgaatgag agccggatat ctgctccgtc gcatgtcaca tatgttttcc cgtacgcgac 340561
tttgccgacc gtctgttcag cagaacctgt tggtagggaa agttggtcgt cccgccgcca 340621
agggaaggcg cgaatggcag tcgaagaaac ggcggcagga agaggcgcaa cacgctcccc 340681
caaaagacta ccgtcaccgg ccctgacgct taagatcgca gccctgatgg tccggccgat 340741
ttctgtccgg cttgcgttca cgaggacatc gacagtccct tcgtcatagc cggagagctt 340801
ccatctggag tcaacgagga cgaagcttcc gctcgcttgg ccgaggctgt tccaccaata 340861
ctcgatcggc tctccttgtg gatcctccgc tcccgtgccg tccaggacat gcgcgaggtt 340921
ttcgtcgagg agttccgcca atgacatgtt ggcctgccaa tagcgggtat cgcgccccag 340981
cagacaaaga gctccttcgg atccacagtg ccgctcagga tattcggatg ggtcgcaggt 341041
cagaaaaaca tgggggcgca ggcgtggaaa ggtatctgga taaactgccc gcagcccaat 341101
cgttcttccg tcgttcaatg gccatgaaaa ctcgattcga aggattccgg cagccgccgc 341161
ctcttcatct acgaggaggc tctctccagc agcagaatga agcttttgaa gttccgccag 341221
cctcctgcgc cctgctggtg tgacagcaag agcaggaggt ggctcaaagt cggtgtatgg 341281
cttcatgttc aaccaacgtg cttcggaggc actttgggtg gaacgcttgg acccggatga

Figure 3 (Cont.)

341341
ttcggcggac caggcggatg accgggatga ccaggatgat cgggattgcc gggctcgcgt 341401
cccggattgt cagctttgcc tgccatctga ggctccttct ttctgcggtc ggtgctaagt 341461
tttagtgttg ttcgactagg cgtcttcagg cacggtgaac ggcttaagaa gcgtatacct 341521
ggttggtatt ccatgcgaag aacttattgg tgtatccgta gtcggccgat tcgtcgaaaa 341581
ttgcgtcatt catgtcgagc gtccgtttca gcttggtagc tgtgagccca ggactgtgtt 341641
gcggcccctt ttcgctgatg tctttgatat tgatggtcac ggcttgtcct caattgactt 341701
actaattggg ccgaggacct tgacgagcca gcctctcaat atggagcgac tatacgaccg 341761
cgcctaagtc agatttcacc atttataggg tggaagacgc aggatatcag caacttttca 341821
gctggcccgc agggttgctg caagtaagtg cgatggcccc aaaaggtgac gcgatccagt 341881
cggcggaaag gaccagggcg ttagtactgc ttgccgcgac ttgaaggcgc agcccgtcgg 341941
aggaggagct cgcatttttc ggtcgggttc acgccgacgc gatgccgcgt ccggcgctgt 342001
cggaagcaat gcgtgtctcc ttccttggga cggcgccgtt gccgaactcg gcaaagatgg 342061
cagcgatgaa cgacgcttct ggaaatacag gacgacgccc gcagatacat ttgagctgcg 342121
cgtgggcgtc gctgcagccg agcaagctgc gaggccgcga ccttcacgta caacgctgtt

Figure 3 (Cont.)

342181
gtgttgatgc tgcgatgtac gagaagatcg gcgacctcgt tgatcggcct tcggatgtga 342241
gaagttgctg ccgaacgggt accggaggtc acgatagcga cacccgatgc tcgacagcat 342301
caaggacctg ctcagccgtc aacgcctcga ggttttggta gggatggtga tggcggaacc 342361
aatccagaaa gcgtcggccg cgcagaagaa cgccttcgcg ggtgttcggc tccagccccg 342421
taccctatgc agataatcca aaaaggaggc cagaagcgga gcatccgggt caacctcttc 342481
acttgcaacg gggagccacc cgccgtgcgt gccccagcgc cgacacggcc ccaatgcgcg 342541
gaggatccgt actaaacgcg cccaaatagc gttgacgaca tggatcggca tcgaccgcag 342601
tgcgtctcgg caaaccggct aaagcgcgca attcggctca ggtaaatctt gccgacgctc 342661
gcttgtaacc aagcgtgaaa aaatattccg cgaggcgatc catctcgccg cggagcgcac 342721
cactactagc cgcttgagca ccccaccata cgaaaaatat gactcgagca taccgcccct 342781
ccggcatagc ggcgcagggg gatcccgcgc ctacctcaga ggaaccaatc ttatttcgac 342841
caccgcgtcc gccgcacacc gcaccggtgt ttcgcagctc gaatgccggt atggagcagg 342901
tcggccgcgc cgagcgtcac aacgccgtgg tcgcttaact tcccacaaaa ccctcgtgct 342961
ctccaggcat catacagttt ctcctgggta tcgccctccc atgttgccgc tgatgcacca

gatagttggc cgcgagagcc cgcggctcgg cccagacctg acatcctgct gtccctccta 343081
cgctcattcg gtttgcagca ccacgtggaa cctgccgcct cgtgccatga ggagtcttga 343141
aaaggcgccc tgttcacaag gaagcgcctc ggcaggtttt ggtcagtgcc catgcgtgcg 343201
ttcagccgta ggtagttaat cggaactgga cctgaacgcg taattggccg ctgctagatc 343261
aactgcatcg ttcaccgttc tcacacgttg aggttcagca cacatgaggt gcatcgggtg 343321
tgcatgaata cccaaagcgg tttcaaagaa ctcgagatcg tcatgcgcgc gataccggcg 343381
gtttctagca atggcccgaa cgaatgcagg gtcaaactta taaacaccca ttagattcca 343441
atctgcagag gcgtgatgct ggcttgaagg gcggtcgggt agcactgctg taaggcgcag 343501
cgcatcgtcc gccagtacgc gcagggatcg tccgccctgt gttttgctga ctacggcaat 343561
attgcggtct tgcgaccgca acaggcgttc gatcacatcg aagtctatga ccaaattctc 343621
cgtgaacacc agcacgtcgc catcaacgtg ggcgatctca tttgccgttg ctgcgtccac 343681
gagacgtccg gcattcggcc tgggcagagc gcgtaagcag agctccatcc cattcagctc 343741
gccaccgagg tcgccggcta tttcgcctaa agtttctcgg gccagcacca tcgtcctctg 343801
caccccagcg tgtgccaatt gagataataa gcgtcgcaga accgacgtgc cgccaaccac 343861
acctagagct gctgaaaagc gcctcttaca cgtcgagatc atctgttgtg ggtcggtaat

Figure 3 (Cont.)

343921
aacaatcccc aagctctgaa cttcgcgcat ttcgtcgatc ctcggactga gaacttcctc 343981
aaaatctatc tgagggcgag cgttctatct actaccaggg caaatagtat tggtgcgact 344041
tcgaagtcgg actgtaggtg aagtgcgcaa aagagttgag gtgtattgat gggtcaatgt 344101
tccgtaagac cgtatgtcct tcttcgggag tgaggtggct cgccctagac tgttcttccg 344161
agggttgctc ggacaggccg ggccgatcct cataacagga ggacgagccg tggctgatta 344221
tagagaagct tttgtcggaa tcgatgttgc aaaattaaag aacgcgattg cggtcgccga 344281
atccggtcga aacggcgagg tacgatactg gggcgaggtc gaggcgtctg atgcagggat 344341
acgtcgcgcg atcaagcaga tcacggcgaa gtttgaacac gtgtatttct gttacgaggc 344401
ggggcccact ggctacgggc tctaccggct gatccgctca ctcggccacg aatgcatcgt 344461
tgtggctcca tctttgatcc cgagaaaacc aggcgaccgg gtaaagacga accgccgcga 344521
tgccatttcg ctcgcccggc tattgcgggc cggcgagctc acggcggtgt gggttcccga 344581
tgaagatcat gaggccatgc gcgaccttgt ccgggctcgc acgagtgccg tcgagacgct 344641
gcgcacccat cgccagcagg tcaacgcgtt catgctcaag cacggtcgta tctatcccgg 344701
caagaggagc tggacgatgc gctaccttcg atggctgcaa gaacagcact tcgaccatcc

Figure 3 (Cont.)

344761
tgcccatcag atcgcgctgc aggagatggt cgaaacggtc atcgccgaat tcgtgcccca 344821
ctggtcactc gctgcggtcg tatgcgctct gcgggccttg cgcggcgtgg acttgatcgc 344881
cgcggtgacg tttgcgacag aagtgggaga tgccggccgc tttgagagcc cccgccaact 344941
gatggggtat ctcggtcttg ttcccggcga acgatcgacc ggggagacaa caaagaggat 345001
cggcattacc aaggcaggca acagccgagt ccggactttg ctggttgaat gcgcgtggac 345061
gtatcggtat ccgcctcgga tcggcaagag gaagctgtat cgcctcgaag aggtatcatc 345121
gtcggttcgc gagatcgcct ggaaggcgca gacccgcctg acggcccgct accgcatgct 345181
gagcgcccga gggaaaaagt cgacggtcgt gtgcaccgca gtcgcacggg aactcgccgg 345241
cttcatgtgg gcaattgcaa gggaggcgcg acagaccacg tcataacagc cgcgcaccga 345301
ctcgcgcatt ggcggaggcg ggacaacggc aggggaatgt ccgttaaccg ctttgtggcc 345361
ggcaagtccg acgcccgcag taagacagga acagccccag acgcaaaatc gggaatgcgg 345421
tagccaaccc gcgtatcaga gcttgatcac cgacgtcttt cagttccgcc tccaccaatg 345481
cgcaagctat ccacctcgag cgttcctcta cggaacgagc gactcgacgt gtctgcaacg 345541
ttgacagcgg acatcagagc ggcaagcaga ccccatagcc ggaatggcgc gtcgtgcgcc

cgtcgatggc agagcggcga ccattgatgt tctgcgccac atggggcgtc accttcatcg 345661
accgcagatc tttaacgaag tcctttgtgt cataggcctt gtcggcaccc agcgtgatcg 345721
cttgtgtccg gtcggcgaag tgctcgatca tgtgcagagg gcggatgatg gcgacgctga 345781
tcggatagtt ggcaagctcg ggaccgcgat cgggcgaagt ggtcaagcct gatcgttccg 345841
acgtcgatct gacaaatggg tctgtcctcg ttcggaagaa gatattccgc aaggaccgtc 345901
tcgttccagt tcacgcgact caggctgccc ttcgccacta gatgcgtgtg cgcaacgtgg 345961
cttttcttca gccgaaggac caggccttct ttctgagctc ccgtggccac cgcctctgtg 346021
cgaccggcct aaaaaatggt tttgctgaag tccgcaagtt cgccggcctt gatgacggca 346081
agcggttgcg gccgcacgat ctgcggcacc ggtttgccgt gacccgcctg agcatcaaca 346141
acgcgccaac gccctggcgc tgctgccgtt gctgccacct atctcggcca ctccagctac 346201
agtgacacag cccactatct cactggatcg gtggaccttc tggcggcgga gcgcgccttc 346261
cttgatgggg gcggagcgtg acttcggagc tggtcgagaa cccaggccat gcgaaaagct 346321
gcttgttccg ctatgccagg cccatgtgac gggccgctgt gtccgcccac catccggatg 346381
cggaagacaa gatcggggtc gcgatcggtc gcgcaggacc gacgctgcgc cacgtaacga 346441
gcaggttggt aatagatcac ttggccatcg tcgagcgcgg cgtcgacgta tgtaggtgga

Figure 3 (Cont.)

346501
agagatcgct cggggctgag gttgtaatac gggtcgtagc tgcgcagata ccgatactcg 346561
taggcgtcct ggggatctcc atactctgcc gtttccttta gcgtgtacgg cattgtcgag 346621
tccagctggg tatctatgat gtcggccagt gggacctcgg caaccacggc gcggaacaag 346681
ttgggccgaa agacggccgt tgcaagcacc gtacccccgc caccactctt tccctcaata 346741
acgacgccgt cgcgggtggc gaacccacgc tcaataagcc cctcggtagc ggagatgaga 346801
tctgtgtgag taatgcgctt ttggtcgcgg gtagccgcgt cgtgccatgg gcgtccgagc 346861
tcgccacccc ctcgcacgtg cacgatgccg aaagctactt cgcggtcgag caggctcaaa 346921
cgcgccgtca tggaagaggg ccaagcgagg aacgagggca atctcggtat cccgtagcag 346981
ccgtacacac tcaataacac tggtccaggg ctcgttcgat cgcgccgcgc gaccaacgag 347041
atcgggacct gcaccccgtc ttcagcctct gccattacga ccgttgcaag gtattgagtg 347101
gcatcatacc cgggaacgcg ggcctcgcac aggaccaccg atcggtcgtt ggcgaaatca 347161
tgctcgatga aggtgtcggg cgtcacaaac gagctaaccg agtaggtcaa cttcgagctt 347221
cggaacggat gtcgtgcggc cgaatagcaa ccaccggccg acaggccgac ccttatagtg 347281
cagctcggct cgtcgggaac gatcacagcg ccaacccgcc cgcttcgatt acgcgagatc

Figure 3 (Cont.)

347341
aggcgaggac ggaggccttc tcgttccagg aggaccaagt gctgttcgag cacgtggatc 347401
tcgtcgatcg tcacgcccgc tcgatgcggc acgacctcct cccaccgcga cggtgaggga 347461
tcatctatcg gcgcactcac cagccgccag tacggtccag catcatccac ccgaaacagg 347521
aacctgtcgt accagtgctc ggcatagatc tggtgcccca gttcacgcat cacgatccgg 347581
cgccactgac ctcccggctc gtcggcggga agacaccaca cctctgcagc ccctcgctga 347641
acgtaagagg acatgtccga ggtagtaagt acgtcgagga ataaccaagc gccgctctga 347701
gaacgccgaa ccagcaccgc cagtcgctcg tttgcctcct cgaacaccac ctccgagttt 347761
cctcgcccga cgttcaagcg gacgatctga tgatgttgcc gccggtcagg ccgctcccgt 347821
gtgaaaaaga gcgtatgatt gtcggcggcc cagacaacct gcccgacgct acccgcgtct 347881
cgccagacat cgcgtccgtc ggacatgtct cgcaccctta actcgtagcg ctcggcaccg 347941
atgagatcaa cgctaaacgc taggtaacgc ccgtcgtcac tcggctcgaa cacaccgagc 348001
caatagaaga cgtcggcccc gggtatcgcg ttcgggtcga ggacaagctc ggccgaacct 348061
ccggtcaccg gccgccgcca ccataccgga tgaggcagcc cccgctcgtg tccctggaag 348121
tagtcaaacg gcccaacttg gaacggtggc gtggcgccct cgcaaggctg acgcccttcg

atctcggcga tgagctcagt ctttagtctt ctcaggtgag ctgtcgcttg ctctgcatag 348241
ctgttttcgg cttcaagata cgcgcggacg tcgggattct ctcggtcgcg aagccatcca 348301
taccggtcga cagtgacgtc gtcatgaagg acacggatcc gtggctcggc acgcggaagc 348361
ggtggccgca ggctcttgtc ccacatcaca acgctcctga aatgagaaca agcgtcgtat 348421
tcatcaccgc cctccactaa caagtcgatg cgtcgctgca tcgcgcttaa cccgcccatg 348481
aaccggagtc gcgatccgct ttagatgctt gcggccacag atttgtgcag gatgtccaga 348541
ccacgtcgaa gcgtctgctc gtcagttgtc aaaggaggta gaagcttgat aacttgatct 348601
tccgctccgc atcgctctac cacaagtccc tcttcaaagg ccttgcggac gatcctctca 348661
gccagcttac ctgtaccaca attgagcccc aacatcatgc cccttccgcg tacggagagg 348721
ctacgagctc ggttggtctg agccacctgc cgaaggcgct ccgctatgat gcgtcctgtc 348781
tccatgacac gggcagacag cgcatcattc gtccagtact ttcgcaaagc agcggcaccc 348841
gtcacgaacg caagattgtt gcccctgaaa gtcccattgt gttcgcccgg ccgccaaacg 348901
tctaattctg gcttgagcag caaaagggac aaaggcagtc cgcagccact tatagacttc 348961
gacaagacta caacatctgg cgacaaaccc gcaaactcga aactgaagaa attgcctgct 349021
cttccgcaac ctgcctgaat gtcgtcaaca atcagcagga tgccatggct tctgcaaatc

Figure 3 (Cont.)

349081
cgctggatcg actgcagcca ctcttttcgc gcggcgttga tccccccttc gccttgcacg 349141
gtttccagaa tgattgccgc aggtacatct acgccactgc ttgcatcagc gagcacctta 349201
tcgagatatt ccgaagtgtc gttatcggca ccccaatacc cgtcataggg catgaacgcc 349261
accccggctg gcggaaagcc tgccgcgtcc cggtagtatc gattgcccgt aaccgcgagc 349321
gcacccaagc tcatcccatg gaagccgtta gtgaatgaaa ctatgctgtg ccgtccagtg 349381
gccttgcgcg cgagtttcaa agcagcttcc actgcattag cgccggtagg accgcaaaac 349441
tgaaatttgt aagtcagacc acgtggccgc aatattatgg cgtcaaaaca ctccataaac 349501
tctcgtttag ctggcgtagc catgtccaac ccgtggatta ttccatttga tctcaggtat 349561
tgagtcgctt cgtcaagaaa atacggatcg ttgtgaccgt agttaagaac gcctgagcca 349621
gagagaaaat cgataaactc gcggccgctc tcgtcatgca gaatggcgcc tgcggctttc 349681
tcaaacacca cggggaacga tcgcgaataa aatcgcacgt tcgattcgag gctctcgaag 349741
gcgtagagtg aattggactt actctcgttt gacatgattt tcctcaacaa gacgatggcg 349801
tcagagcggc gcgcctcatg ctcttgaaac cgatgccaat gccacatcgg aattttacgt 349861
ggctccgcgg ttttacacgg cgatgcaggc ccacgcgcct acccaggctg gcagtatcgt

Figure 3 (Cont.)

349921
cggtgccact tcttcagtat attcgcgtgt tctgatatga ctagacgaga accaggagag 349981
tttgcccctg gtgcctttcg acatccgatt tcctgagagc ttgaaactat ctgagtcgca 350041
ctacttattg cagacgcgag aggacatgta gccgccatgc agccagatgc ggctcccacg 350101
ataaagactt ggcgctccct ccaagatcgg ttccgagccg agtctgacga tcagccatgt 350161
gggtaactca ctgccgcggt gcagaggccg cgagctctga atgcaggctc acaagagtag 350221
cagcgtggcc gatgttcgaa tcacctgtac tccctttaga gagtgcccga gcctgacgtt 350281
gcttggtcgc ttcttacaat tcgataattc caaggcttat tgctttaatc gctgcgacgg 350341
ttctgctcga agtacccaac ttccgcatca cgttcttaat gtgaaagttc acagtatttt 350401
cggaaatccg cataataacc cctatgtccc acgaagattt ccctcgtgcc acccacaaca 350461
cacactcttt ttctcttaaa gaaagggcag gaatttttg gacggcgttc aaattcgcga 350521
ttttcgcgac tctcagatgg aaatgggtcg cggcaagttg taaataggcg attgttctgt 350581
cgtggaattc acgctcgcaa tgccgagcaa agctcatgat cgcgcagcta cctctagggc 350641
cacgcaatgg aacagtaatg ccggacctca agccaaacat tgcagcctcg tcaaacatgc 350701
gccgctcgta ttcagtggtg cttgcgtcac tgtacatgtc gctccatcga atcgggccag

cccccattcg actctctttg atgacagggg ctatcgtctc gtaacccatt tcgagacatc 350821
gctcccgcca accatcagga taattcagaa tctcttccga gtcgcatttc actcggttca 350881
gagccttatg gtcgcttgta agcggaccat aggccagcca cttgcagcca aatttaaacg 350941
caaaagccga caaaaggtcg aacaattttt ttggttgagc gacaccatct gtcaggtcga 351001
gaagccggcc gagctcgacc acatactcgt ccctacctgc gtttgagaaa tggatcgatc 351061
ctcccaagga ctgatcagaa actccggtgg ccgatccgcg gacttgaggg aaactgcagc 351121
catccgcgag tcttccacag tctcgctcga gtgacgaatc gcccgccatg tagtcaccgg 351181
tgcacgacgc ggcagccgat gaggcattac cgctctgcgc ccccaccggc cggtattgca 351241
gggcgctcaa tgcaagtcga tggagatctg gcatcttgct ctcctccttc gtccgttgag 351301
taatgtatat cgttgacgag tcctactcgc gtcgccaatg aggttcaaaa gtcgtgccaa 351361
gtttgcagaa agggggcgtc aacgaaattc ttgttcgttt gtcagggatt tgaacaccat 351421
gcagccagta ctcagccgca tgccgctacg tcgtgggctc gacaaacgcg acagtagtgt 351481
ccgttgcgtg gttgcactgt gaggctatgc attacgcatc ggccatttgc ttgtccagga 351541
agccgttcgg caatccaaag cgggagccgc agcctgctgc ctcgactgcg aactagtttc 351601
agaacgaggc gcagacatag aagctcacat cggctcacaa cgcgctacga tatccggccg

Figure 3 (Cont.)

351661
ccaccccctt ccgccagacg gggttccctt gccgctctta cggtcgagat cactttcgca 351721
taccacaacg gcgacgaggc catactcagg gccaaacagg agacttcttc aacagcctgc 351781
tagggctagc tgtaggcgta gacatagatc ctcacagtca gagaaatcgt aagcggtcag 351841
ccgatagcgt caggcttgaa gttccagggc atgagcgctt cgatttcgga tgcgggccag 351901
ccttgagcaa tgcgggtcaa ggtctgcgag agccagtcga gcggatcgac gccattcatt 351961
ttgcaggtct gcagcaaggt ggccaccgtc gcccaggttc gtccaccgcc ctcgctgccg 352021
gcgaatagac tgttctttct cgtaatcgtt tggggcctga tcgcccgttc gacgatgttg 352081
gagtcgatct cgatacggcc gtccgtcaga aagcgctcca gcgcctcgcg ccgggtgagc 352141
gcgtagcgga tcgcctcggc ggttttggat tttcccgaga ccttgcccag ctccttttcc 352201
cacagctcga agaggctggc gacgatggcc gaggactttt cctggcggag ttcagcgcgg 352261
cttgcggcat ccttgccgcg cacttcatcc tcgagcctcc acaactcggt catggcgatg 352321
attgaatccg ttgcggcttg cgagaccccg ctgatgtgca ggtcgtaaaa cttgcggcgc 352381
aggtgcgccc agcaccctgc gagctggatc gtttcattgc tgccggtttt ggcccgcgcc 352441
ttggccaggt tggtataagc tgagtagcca tccacttgca gaatgccgct gaatccggcg

Figure 3 (Cont.)

352501
agatgacgcg ccacgcaatc ggcgcccctg ccgtcttcaa aacggtaggc caccatcggc 352561
ggactggttc cgccataggg tcgatcatcg cgtgcgtaag cccacagcca ggccttggtg 352621
gttttcccgg aaccgggggc aagggtgggc aaggtcgtct cgtcggcgaa gaccctttcg 352681
ccctccttga cgcgctccag gatataatcg gcgagcatct gcaactcgaa gcccagatgc 352741
cccatccact gcgccatcag tgatcggctg acctcgacac catcgcgcag atagatcgcc 352801
tcctgccggt aaagcggaag gccgtcggcg tattttgaca cggcgatata ggcgagcagc 352861
cgctccgtcg gcaggccgct ttcgatgagg tgtgccggcg ccagtgcctg aaccacgccg 352921
tcgcggcctc ggaaagcgta tttcgggcgg cgcgtcacga tgacccggaa cttcggcggc 352981
acgacgtcca gccgctcgga gcggtcctcg ccgatcagaa ccttttccag ccccgcgcag 353041
tcggccggga cttccggctc gataacctcc tcgatgcgtt cgaggtgtgc ggcaaagccc 353101
ttgcgcggac gcggcgcacg cttcggcttg tccccggccg cgcggttgag ttcgctctgg 353161
atttccgaaa ggccggtttc gacctcctcg aacgcaaagg acacctgttc gtcgttgaca 353221
gccaagcgca gccgctcgga ccgcgtgcca tgttgcgtgc gctgcagaac tttcaggatc 353281
gacgtgaggt tggcgatccg ctcgttggcg cttttctcga cggccttcag ccgggcgacc

tctgccgccg cggctgcaag tcgggcctcg ttcgcagctc gctccttggc cattgcgagg 353401
atcatcgctt tcagcgcatc gacgtcgtcg ggaagatcgg caacaggcaa aaccatggga 353461
ggcaatagag cacaaaaaca gccgttttcc caaccgttac agccacatga ttcatcatgt 353521
cgcaggccgg tttcagcccg ttaacaacgg ccgcctgacc ttggccgggc ggatcttttt 353581
ccaatcgagc ccggccagaa gcgccatcaa ctgcgaatgg tccagacgca tccgcgccgc 353641
cgatatgccc ggccagcaga agctttgctc ttccagagtt ttcgaataga ggcagacccc 353701
gctgccgtcc caccaaacta tccgaacacg gtccgcccgc ttcgatcgga acacgtaaag 353761
cgaaccattg aacggttatg tgccgcacca cataatgcag agcgttttta gcgtggcgtc 353821
gcgtgtatcc acgttgacgc gcgcgccgag gcggatggcg acggtgcgct aaaaacgtgt 353881
tggactaagc cgcgggtgcg tttcaggtcc tatgggtatt gaatggtgcg gctcgaagga 353941
aaggcgtcgc aggggcggtg atgacgtacg ccgccgctgg gtgcacggga cgaaagcagc 354001
gccgatatgg aattcgacag gggttgagat tgccattgta acctgccggg aaggatcggt 354061
aggcgcaacg gcacgcacct tctcgggacc gaccggtttc cggcggaacg gtgcgacggt 354121
gacgatgaaa gcgcttcttt catgacgtgt cccagcatcg cggcggtccg gtgacgccgt 354181
cgaagatttc gatggtgatc atctgccctt gatgacaggc cgggcattgt ctgagggaac

Figure 3 (Cont.)

354241
gcccggtgag ttcctcgtag cggtcgcggt actccttcgg cgcctgggtc tccgatgggg 354301
cgggaacgga catgccgagc aggtcgcggc attgggcaag cttttgttcg cgatagcgat 354361
tgccgaggaa accgtaatag cggatgcggt ggaagccctc aggcaggacg tgtaacagaa 354421
agcggcggat gaattcgtcg gtcgacacgg tcatgacctt ttgccggtcg ccgtgccgat 354481
aatccttcca gcggaaacgc accgctccat cttcgatatc gacgagccgg ttgttggaga 354541
tggcaacgcg gtgcgtataa cggccgacgt aatcgagcac ctgttcgggc ccggcgaagg 354601
gcggcttggc aaagacgacc cactcggcct ttcgcagcgg cgccagatag cgccggaagg 354661
cgttgcgctc gttgagggct cgcaagtcgg agaagaactg cagcttgccg ccgtcgaagg 354721
ctttctccag gtgctccaga aacaagcgtc ggaacaggcg agagagcacg cggaccggca 354781
ggaagaagcc gggtttgcag gcgatccatt gcgtgccgtc cggcgagaac ccgccacccg 354841
ggacgacgca gtgcagatgg ggatggtgca gtagattttg cccccaggtg tgcaggacgg 354901
cgaagaagcc gatctcggcg ccgagatgtc gggggtcggc agcgatggtg cgtagcgtct 354961
cggcggtggc gcggaagagc agcccgtaaa cgagcgcctt gttctggtaa gcgatggcgg 355021
caatggcctc cggcagtgtg aagacgacgt gaaagtactg tgtttcgagc agctcggcgc

Figure 3 (Cont.)

355081
gacgatcctc cagccattgc gcacgggcaa gcgattggca gcgggggcaa tgcctgtcgc 355141
ggcagctgtt gaaggcgatg cgccggtggc cgcattgatc gcacgcttcg acgtgcccac 355201
cgagcgcggc ggtccggcac aactcgatcg ccgtcatgac gcggcgctgc gcggtcgaaa 355261
gcgacgtgtg ctgggcacga taggcctcgc cgtagcgacg gaagatatcc gccacttccg 355321
gccccgaacg ggccatcggg agctcagaaa tactcaggtt tggcgggcgg cggcgtgggc 355381
gccggacggg gcaaaagctc gaacgggctt gaggtggcgc agactttgtt ggtggcgatg 355441
cgcaggtagt gggcggtggt cgcgaggctg cggtgaccga gcagcaattg aatggtgcgc 355501
acgtcggcgc cggcctcaag gagatggacg gcgaaggcat gccgcaagct atgtggcgtc 355561
accggtttgg acaagcggga gagatcgtgc gctttcgcac aggcttgccc gactgcatcc 355621
cgagtgatcg ggtggccggc gcgatctccg gggaagagcc actcttttgg ccgcggcatc 355681
ctccaatagt cgcgcaggat ctccaggagc ttgggcgaca acatcacata gcggtccttc 355741
tggcctttac cctgctcgac acggacgacc attctctggc tgtcgatgtc cgtgggcttc 355801
agctgaaccg cttccgagat gcgcaagcca gcggcatagc acgtcgtcag gatggcgtgg 355861
tgtttgagat caagcacgca gccgagaaag tgctgtactt catccggact gaggatgatc

ggcagcttct gcggcttctt cggaagcggc aatacctctg caggcaccca gtccctctcg 355981
agtgtgacgc tgaagaaaaa gcgcaacgcc gcaatggcga tatggattga gttaggcgcc 356041
agcttcttct cgttggccag atagacctga taggtccgaa tatcctcgcg gccgagcaag 356101
tccggcgcct tgccgaagtg tcgtgcaaac agcgacacct gccgcagata tgaaagctgg 356161
gtattgagcg agaaattgcg cacctgcatg tcctcgctca tgcgctggcg aagtggggtc 356221
atgacgagct cctctgtctg atggaatagg ctgccaaaca gccgtcccat cgtcgcgcag 356281
ttggggctcc tactgaatac atgacctcct tgccgctccg cggtagcgga gcgggttagt 356341
ccaaatgcga ttatgtgccg ggcgagatta tgtggcggag ccgtcgcggc gccagccgag 356401
gcccgtctaa tctggaattc tccgccacat aatagtcaga tactgttcag tagttgcagc 356461
acggcgtcat ttggtcggaa acggatgccc agatcgccgg cgactccagc cttctcgaga 356521
cctttgcgca tcatctcgac atcggcggcg gcatagcgat gggttgtagc gacctgtgcg 356581
tgcccgagcc aggcttggat cgttaaaagg tcaacgcccg cctggagaag cttcatggcc 356641
agtgagtgtc ggctatgtct tgatcgatat aggcgacact atctaccccg ccggactatg 356701
tcgtgtaact agatttcgat caaagatttc aatgctttat agatagcgtg tagagatagt 356761
tcgtagccct tccagcaatc cagcttggga agggagcgaa gaatgaagta tttcgtcaat

Figure 3 (Cont.)

356821
gccgattttg cgctgtcgcg gccgccagag ggcccggtgg cgatttacat tattcctttt 356881
gccgaatggc tcgttgatcg aggctacggc cttgtttcta caaggaacca ggtgctgatg 356941
gctgccggct tcagcagttg gcttcggcaa aaggggattg gactcagcga cataaatgga 357001
gagcatgctg ggcgttattt gctcgaccga gtgcagcgcc caaagcttgg agatgacgcc 357061
gctcttcgac atctattggc ttttcttcga agtcaaaacg cgatcgccga agagattgag 357121
gtcgatcaca acccgtcagc ggtagaacaa catgtgcagg catatgagcg gcatctgcga 357181
gacgcccgtg ccctgtcgcg tcaaacgatc ataaattacc gacctgttgt ccgggatttt 357241
ctcagcttcc gcttcggtga tggcgagatc tcgctcgcac aattgcgcgc cgccgacgtg 357301
accgatttcg tgcaaaagaa ggtatcgcgc ctcaatatgc gacgcgcaaa gattgtgacc 357361
acggcactgc ggtcatttct ctcctatgcg cgttatcggg gggacatcac gtcggacctc 357421
gcggccgcgg tcccgatcgt ggctaattgg tcgctctcat ccattcctcg tgcaatcggc 357481
cgcgatgacg tgagccgatt gctctccagc atcgatcggg atacgcccat cggatgtcgc 357541
gattatgcga tgatcctcgc attggcgcga ctgggattgc ggtcgagcga ggtggtgacg 357601
ctcgagctcg acgatattga ctgggtagcc ggacggatcc gggtgcgcgg taaacacgga

Figure 3 (Cont.)

357661
cgtaacgaac ttccgttgcc ggcggacgtt ggcgaggcga ttgccgacta cctgtggagg 357721
gcgcgtccgc gcaatgccag tcgccgtgtt tttctacgcg acaaggcccc gatccgaggc 357781
ttcgtgggcc cgagcggact cgggtcaatt gtcagacgct cactcaagag gaccggcatc 357841
gactctccaa caaagggaac gcaccaattc cgacatgggc ttgcctcgga gatgctgcgt 357901
ggcggcgcgt cgctgggtga gatcggcgaa gtcctgggac accgtcatgt gcagacaacg 357961
gcaatttacg ccaaggtcga tctcgacgcg ttgcgaacac tggctttgcc atggccggga 358021
gaagcccaat gagcacattc cgacaggctg ttcaggagta catcgagatg cggcgagggc 358081
tggggttcaa gctgcgagag acagaacggg gattgatcga tttcgccgcc ttcctggagg 358141
ccaacgacac gccacacatc acgacggaac tggcccttgc ctgggctcag cgaccgtcgc 358201
gggcgcagcc ttcgcattgg gcgacacggc tgggctatgt ccgcgtattc gcccgttatc 358261
gggccgccgc cgatccgcga actcagattc ctccaagcgg cttgcttccc tttcgcccga 358321
agcgggctcg accatatctc tattcgaagg aagacatcca acgcctcctg tcggccgctc 358381
tggagatgcc gtgtcgatat acccgctgca agctcaggcc atggacatat tattgcctgt 358441
tcgggctgct gagcgtttcc ggcttgcggc tcggcgaggc gcgcaacctc aagctcgcgg

acgttgattt cgacgctgcg gtgttgacga tccgcggaac gaagttcgga aagtcccgtc 358561
ttgtaccgat gcacgcatcg acatgcgcag tgctccgcga ttatctcaaa cgccgacgac 358621
agcattgtgc agcccaggcg gcatctccct atttattcac ttcgcaactg ggcaatcgcc 358681
ttgatgtcgg agacattcac cgaacattct atgctctgtc tcgccaaatc ggcctgcgcg 358741
gcgcaactga cagccacggt ccgcggctgc atgacatgcg gcatgtgttc gccacgaaca 358801
cgctggtgcg ctggtacgaa gccgagcaag atcccgagcg gctcctgccc attctgtcca 358861
cctatctcgg tcatgtccac gtggccgata cccaatggta cctcaccggt tcacccgagc 358921
tgatgaaaga agcaatgcgc cgccttgaac gtcgctggga ggatcggaca tgaccaagca 358981
cgccagcctc gcgccactct tggagagctt tttcctccaa cgcctgatgc aacagcggca 359041
ggcaagcccc catacgatca gttcctatcg cgatacattt cggcaactgc tgaagttcgc 359101
agaacgaaga ttgcgcaagc cgccctctcg cctgaacttc gaggagatcg acgcgccgct 359161
gatcgttgcc ttccttgatg acctggagaa ccgccagggt atcagcgtcc gcagccgcaa 359221
cctgcgcctc acggcgattc attccttctt tcgctatgcg gccttcgaga tacccgagca 359281
ttccgcccaa atccaacgcg tgcttgcgat tcccagcaag cgcttcaccc gaaccctcgt 359341
taatttcctg acccgtccgg aggtcgatgc cttgctggcc gcaccggatc gatcgacctg

Figure 3 (Cont.)

359401
gtccggccgc cgcgaccacg cgttcctcct ggtcgcggtg cagaccggat tgcgcctatc 359461
ggagatcacc ggtctcaagc gggatgatct gttcttcggc acgggggccc acctgcgcgt 359521
cattggtaaa gggcgcaagg aacgctgcac cccgttcgcc aagtctacga ccgccgtctt 359581
gagaaactgg ctgaaagagc cgcagcgcgg agaccaaggt atcctgtttc ccagcgccag 359641
aggtgagcgg ctgagcgttc atggcgttca gtatatgctg aacaaacacc gtcagatcgc 359701
ttctgccatg agcccgtcgc tggagggaaa gcgcgtcact gttcatcgtc tgaggcacac 359761
gatggccatg gacctcctac aggccggcgt cgatcgcgcc gtcatcgccc tgtggctcgg 359821
ccatgaatcg gtcgagacga cacaaatcta tctcgaggcg acgttggcga tgaaggaggc 359881
ggcgttggca aagacatccc catattccgg gaagtcatcc cgattccggc ccgacgacaa 359941
tctgctggcg ttcttgaaca gcctgtagat cccgctgact atgtcgtgtg gctcggccga 360001
tcctgtagga aatctcgttg ttcctcagac gcttgcgttt tcggtacccg acatagtcgg 360061
gtggggtaga tagtgtcgga agatgtgcgg cgatataggc ttttgggcca aggtcggcct 360121
gatggtcacg gcctgggcca ccgcacgccg cacgatgtgg gttgctccga agcgcgtcag 360181
gcgctcgttg cgggcgccga cgaatatcgg tcgcggctcg tggttcgcga ttccgtgctc

Figure 3 (Cont.)

360241
ggccaacaag gctgtcagtg ctctcgccag atcctgagga atggggatga cgcggtctct 360301
gcgccctttg ccgcgcagca gcacttgcgg gtgcgaccgt tccaactgaa ggtcgtttgc 360361
gttgacgccg gtagcttcgg agacccgcgc gccggtccgt gccaggaaca gtaaaaacgt 360421
gcggtcacgc cgaccacggg gcgtccttgg attgggcgcc tcaatgaggg cgtccacttc 360481
ggccttggtg aggtgatgcg tcacctcgat gtgcgcccgt tttatgggaa tcgtcagcac 360541
gcgttgggcg acaccgaagg acgccggatc ggcggccgcg acatggtgga agaacgatcg 360601
gatcgccgct aggcgggcgt tgcgcgtggc gatcgtgttg ttccgcttct cctcgagttc 360661
gtcgagaaac gcgagaatga ggtctcgatc gagctcctcg agcaccagag ccgccggctt 360721
cttccgcaac cgggtggcgg caaagaggat gagcatgcgc aaggcgtcgc gatagctggc 360781
catggtcgcg ggagtcgcgt tgcgttgttt ggtcaagcgc cggcgaaagt aggactccag 360841
gagcggcgcc aggagtaagt gttcgctcat gctgcgcctc catcgaggaa ggcgcgctcc 360901
gccgccatgg cgagaagatc caccgagcca gtgaggtagt aggctgtgtc actgtaattg 360961
gcgtggccga gataggtggc gagcaccggg agtagcgcct ggacgttggc gcgttgttga 361021
tgccaaaggc tcatgcgggt cacggcaaac cggtgccgca gatcgtgcgg ccgcaacgtc

ttgccgtcat caaggccggc gaacttgcgg acctgagcaa atccgcattg caagccagtc 361141
gccgagaggc ggttgccacg agagctgagg aagaaggcct ggtccttggg actgggaaaa 361201
gcggcatcgc gctcacgggc atagcgacaa agcgctgttt gggtcgtcgc gtgaaccgga 361261
acgagacgat ccttgcggaa cttcgtcttc cgaaccagaa gaaccccgtt ggtcagatcg 361321
acatcggaac gatcaagcct gaccacttcg cccgaccgca gtcccgagct tgctaacagt 361381
ccgatcagcg tcgccatcgt cagccccctg agagggatgc ctggcgaaat gcgggcgcat 361441
gcgtcgatga gcgacgccaa ctctgcctcg ctgaggatac gtggaggcgg aatcgccctg 361501
gatctaggaa aggctctgcg cttcagggct tcggtttggg cgtcatagac agcgagatac 361561
tcgtagaatc ggcggagcac gccgtgacga gtggcgcggc tgttggcggc gccgccgaac 361621
gacaggacga agtccagcgc catagtccgg gtggcgggcg catcgaattg agcgcgttca 361681
acgtagcgga cgaaagcccg caacgtgccg gcttgtttgc tgaaggcata gccgagcgag 361741
tgacgcaggt cgatgtaacg ctcgaccttc tcgccgagga atcgggcaaa ggcggtcatg 361801
cagcgcctcc cggaaagggg agtgcgacct cggcgagttg cgaggccgca acctttacgt 361861
acagcgccgt tgtgttgatg ctccggtgac caagaagatc ggcgacctcg ttgattggcc 361921
ttcgctgccc gacaagctgg gtggcgaggc tgtggcgcag gagatgtgca cctgcgaccc

Figure 3 (Cont.)

361981
gcccgagttc gaccccgcca tgtcgcaatc gcttcctcac gatccttgat acaggcgccg 362041
cagacttgaa cgctcccacc ggcggcgtga acgacaggaa cagatacgga ctgtccacct 362101
tcggtcgagc gcgcaggatg tagtcgacga gtgcggcgcc ggtctcctca aggagtggca 362161
ccacccgatc acgcttgccc ttggtgcgcc ggataaaaac ctcgccagta cgccagtcga 362221
tatcctgcag ccgaatggcg cgtaactcgc cgttgcgaat gcccgtggtg gcgagcagca 362281
gcaggacggc tcgatcgcgg atagcgaccg gcgtcgttgc gccgatcgca tcgattgcgc 362341
gccgaacgtc accccatgca aggcgcggcg gcagatgcgc caaacgccaa tagggcgtcc 362401
tcgggacgat gcgggcaaga tcttggcgat ggtggccagc ccaacataag aaccgaagaa 362461
atgttcgaat gtgagaggtc gctgccgtgc gggtgccgga ggtcgccgat agcgacagcc 362521
gatgctcgac agcagcgagc acgtgctcgg ccgtcaacgc ctcaagattt tggccggggt 362581
ggcgatggcg gaaccaatcc aaaaagcggc ggccgcccag aagaatacct tcgcgggtct 362641
tcggctccag gccccgtacc gtgcgcagat agtccgaaaa ggaggccaga agcagagcat 362701
ccgggtcagc ctcttcactt ggaacgggaa taatgaaccg ctccggagcc actcgccgtg 362761
cgtgtgccag agccgatacg gccccgatcc gcggagtatc tgtagtaaac gtgcccaaat

Figure 3 (Cont.)

362821
agctgtcgat gacatcttga tggattggca tcaagccaca gcgcgtcgcg gcaaactggc 362881
taaaacgcgc aacccggctc aggtaaatct tggcggacgc tcgcttataa ccgagcgtaa 362941
gaaaatgctc ggcgaggcga tccatctcgc caccgagcgc accgctacgt aggcgcttga 363001
gcaccccacg atacgagaaa tagaactcga gcatgttgtc cctccggaat agcggcgcgg 363061
ggggatcccg cactcatcca agaggcacga aatattatgt ggcggagaat tccagattag 363121
gcgggcctcg gctggcgctg ggacggctcc gccacataat ctcgcccggc acataagaac 363181
gggtcgaggc cgccgtccct caccagcgcc atcaaagacg cggctccctt gcggaagtcg 363241
accggctggc acgacacgta aaccacaact ccggaagcga tcatacctag cggaccaccc 363301
ggagaatctt ggccaggtga tcgggatcga catcggcgcc ggcgcgcacc acgatatcgc 363361
ccacgacgat ttccaccatc gaactgccca ccgcttcaaa gcgcgtgaac ttgactggcg 363421
cgggcgctcc ctccgtcaat ggcgcgacca ttcccgacga gagcgcctta cgacgccagg 363481
catagagctg cgacgggtcc aatccctgag accgcgcaat cgccgacaca ttggcccccg 363541
gcgagagcgc ttcggcgaca agctgcgcct tctcctcgtc cgaccaatga cgcggcttgc 363601
gtcgagaccg caccggctcc gccgtcagga cctcgaatgt tcgatgatga tgatgattca

cactgtcgct cataggtttc tccgcatgac tcatgcagag aatgaccgtt cagcggccct 363721
aaagatacgt ggggtgacct acccgcttac gagaaatcga atgtctgcct tatctagtca 363781
cgcgttaagc cggccagatg gggtctgctg gtcggtttcg aatcactgaa gcgtcgacag 363841
cctcagcttt ctcgtccgga tccgatggat agtctatgga aagctcacaa ctggttagtc 363901
cggaaagtac agcggagtat attgttcctg atcatgaagg tccgagaatg gtgaaataga 363961
ccaatcgatt gattcaactg cgcgttgaat tatcgtatca gcgctggagc gcgagggcgc 364021
tacagcaacg acatatccaa ttcggtcaca gtaatcacca tttctgacta ttggcgttcc 364081
tggtctaaca tacaatttga cgtccgcgac accgggtata gctgccgccc ggtcgatacc 364141
atcaatgtaa tcaagtgtgc catcgcgatc cgcaatcaag gatcgggcgg tcgctgttcg 364201
tgactgcctc ttcgacaaat tgcattgttc accaatagca agcttgatgt gctcgccgat 364261
gagatcgacg tcgaaggcca gctgaaccaa ttgcggatca ggattaccag caagtcgcgg 364321
gttgacttca ataacgactg gaccgacctc ggtccaccgg aactcaatgt tcgttggtcc 364381
ccagccaagg ccgagtgccc ggaggcagcg ttgtacaaca tcaacggcac gctcgtactg 364441
ctcatcggtc aagggtgcag gaaaggtcaa ctggcggaac acgaaatgcg gcggtgggcc 364501
atactcagtg atgcctattc caataacttc gtctcccatg atctcggcga tgtaatgagg

Figure 3 (Cont.)

364561
gccatccacg aactgctcta ccaatacctc gggtgaagat cgccacatgt gcttcccgcc 364621
caatagataa tctgtgtgtt cagctagctc gcgagcgtcg cgacacaagc ggactcctcg 364681
gctaccgctg ccgactgcag gcttaagtac tgctggcagg ccgatctccg ctgcaacgca 364741
ttgtacttcg gcggctgtgg tcgccgaccg atagccaggc acgggaactc cggctgccgc 364801
aaggacctga cgttgggcgg ccttattgca gcattgttca attgattccg gatcaggtcc 364861
aggtagattg aaattccgac agatcttgcc aactgtcgca tagaacgact ctgcggcaga 364921
tgtaactccg gctatgtcga aactcttacc cagccgagaa tattcgccga tcagagcatc 364981
caaattggtt gtatcgacgc gagcgacttc aatgcgttcc gccgcgacat agtcgtaaag 365041
tgctggatct gccgccagga ttattggatg tagccgaaga cgccggacgg cttctacgta 365101
cgaccggcca ttagtccgcg tattttcaat taaaatgagc gcttttcgca ttttatctgc 365161
ctctgctgtt acgttctgtg ggtggcccag gcgatctgca tcagttgttt cagccgctga 365221
ggacggtgcc cactcccggc tgtaattgcg catgcacaat cggcgaacgc gtacatcata 365281
aagagccaga gtgaaggagc gtgctgtccc gaacatgatt ttcccactca cgggcgactt 365341
ctgacgtatt cgagagcatc ttgagaagct cgtcgcgagt cgtccagagg agccattcgt

Figure 3 (Cont.)

365401
cgtcgtctat tcctaatgtt ggcaaccgaa ggactgatcc atggggctct cgatgacagt 365461
gtcctgatcg atcgaatatt ctctttttga tgtaccattc ggccacaagt gagtagatga 365521
aatcagggga ccagttcacc caagcaagcg cgaatgcaag gcgaccaagc ggtgctagca 365581
aaccacgacc cctaaagtcg tcgcgaaacc acatgtcacc gcgataagcg actcgcccgg 365641
taatgctgcg agcgctgggt gcgtaacaac gacacgttga gttaaggcct gatttgccga 365701
cggggtccgc aaagcaggcg cgcagcgact ccagatgctc aacaagtgtg gttttggata 365761
gatcgtatag tcgcaatgcc tgtacatggg cgactctgtc ttcttggtca cgccctacaa 365821
tccagaagga gctctcaggt gaaagatcag agtagttcgg attgaagttc ggagtagttg 365881
gatatttgcc tggaagtttg ctggtgatcg ccacgtactg ccgaaaatcg tcgcccattg 365941
caatattgag gcctgcgttg cgggctacat catctgcgca ggaaatgtac tttgaaacgt 366001
caagtgtggt cacgttgctt tgcatgttgg tacaccccgt tttattgcat cggacggctc 366061
tatttctaaa gctctggcca acgctcggat actgcggcat taggtgggtt gacgggcggg 366121
gcggctcgcg gcctcgaaag ggagttagta ccatttaccc cggaccgccc tagcgtttct 366181
gaatgccatt aggaagctcg caacggcgga gcaagtgttg gcacgagaac ttgttcgata

taggcgccga acgctatgtc atgcggatcg aggaattgac ccctcctatt gcctcaccca 366301
ggaatgttac tgaagttgag ggcactgaga tacgggcgcg cactccaacc agtcgccatt 366361
gcgtatgatc tgcccggcta tttcaatccg ccaagccttg acggcctttt gtaccgtccg 366421
caggcttttc tccgtgaagc gtgacggatc ggcgctcttt agacgctgca ggaccgaggc 366481
tgccgagagc gccggatccg cctctagcca cgctcgaatt tgggttcgaa tggctccagc 366541
aggctcggct ttttgggtaa ggcttagtcc gtcgatatgg ccgccgacgt gtcggccgtt 366601
tctctccccg cctgccaggc cgtcttcagg ctcgaggtga atcgctggag atcgatggcg 366661
accggttctt cgggcccgca ttcgagccac ggcgatcgac ccgctttccg agctcctcct 366721
gggcagcacg gatgcccgca aacaacgtca ccggattttc cctttccagc atgccgtcgt 366781
cttttggctt tcacgatcgg gcgatccgtc ggccgggtag ctccgtcctt ccaggccgtt 366841
cgcaaactcg cgaggaaaag gtcgatcggc tgagctatcc cgtcagtgcg catggccggc 366901
ggcgtgtcgg caagcgcagc gagtcgctcc tgcagggcgc gaatatcgcg caatagcagg 366961
actggatcga gcccggcgta gatttcctgc agacggagcg agctgcatct tacgcgcgag 367021
cgtcggcaat caggcgctga tgcggcgtgg ctgggcggac tatacgtctt gcgcacacga 367081
gcaccgtcgc gctgcttcgc cattaatttg aacgatggct gaaagaagtt cacgaacagc

Figure 3 (Cont.)

367141
cgcgctgatc ggtagagctt cgctagcagc gtggcggcct ccagtccctg gaaccgacgg 367201
tatccgacca tcctgcgcac cacggcgcca ttcttctgct cgacaaaggc ccggtcgttc 367261
ttgcggtagg ggcggcagcg cgtgaagacg atgttggcgg cgtcacaata gccttcagcg 367321
tctcgttcat gaagacggtg tcgttgtccg tatccaggcc gagaagcgcg aagggcagtt 367381
gcttgcgcaa ttctgtgagc acactcctca acagtgtctg ttcgcaaccc agcagcggcg 367441
cacattccgt ccagccagtc gcgatgtcgt gagaacaagg gtttggatga agctgccgcg 367501
agccctaggg ccgcaatggg cgacgagatc cgcctcgaca aaacctggcg ccgtcattcc 367561
agcgcgccga cgccggccac cgcgggccac cacacttcgg catccggcag actacgatcg 367621
aatctcatcg ccccttcact ccaagcacaa acgccatctc ttggatggcg caacggcgct 367681
gagctatgcc tgctacttcc gctggccgct catcggatcg cgcttcaacg tctcctgcac 367741
catcagcgac aggccgggaa agcccatgcg catatccgta tagccggtcg cgagcgagac 367801
cttcacaccg atcgggaccg ggatcatcgc cgctccagca catcaagaat ccgaccgagg 367861
gcatcagtgt cgatgtcatt ctggaccccc aggcgacgcc caccgcccgg ctcgatcgtc 367921
accatgcttg ccttcttgcg cgagcgaggg gccggcggcg gctccggtga taccggcctc

Figure 3 (Cont.)

367981
ggcggcactg gcgatgaatg tcgccaggag acgtggtctc aagagagcgg ttgtcgcgct 368041
tggccgccgg ctggaaacga tcatgcatcg catgtggagt gacgaaacgg agtttttgct 368101
ggagcagaaa agaaggtctt ggcccggctc aacgctgctg attgaaggct ccgcgccgag 368161
catggggtct cgagaccgaa cggtggaggt gaagatattc cgcctccggc ggtatggatg 368221
tccttcgcag gacgatggat gaggtgagtt cgttgcaagc gctgtcccgg tcgcatcagt 368281
tgcggtcagg gcgtctccta aatttagtct agtgcccgtc cataaacgcc tgtttttgtg 368341
gaattttcaa aggtttcttg ccggctgacg cgtgtttctt ggacgcgtga tggcgcaatg 368401
ccatgcagat tatcacccga agagcgatct ggcggcaatg ggtcatgggg tatccgccga 368461
cgctcgccgg ggtttgctct gaacagtgcc agacaagggg agtcaggtgt gccggaggcg 368521
ggcgaagagg gagagattgt aagcgaccgc cgaggaccag acataagcct tgaagtggtc 368581
gaggccgcgc caggtgcagc gccccaagcc ataagcgcgt ttcaggcaag agatgccggc 368641
gtcgatgccg gcgcggaagt ttctgagctt gcgatagacc cagcgactcc tgaccatgtc 368701
ttcgatcttg agaccgcgct tcttgtggaa ggccatgtcg cgtatgccgc gggctttggc 368761
tccgctcaga ttttcgcggc tggcatagcc gccgtcggcc gccgcctgac gcggcggctc

gccgtaaaaa gcgatgtggc gttccagcat cggcagcaag cgctcgctgt cggccgggtt 368881
gcccgcttcg atgacaaggt cgaggatcag tccgcttgtg ccggtggtca gattgagttt 368941
gtggccgtag tcgacgtcgc ggctgccctt gacgatgatg tcgacatgcg gctcgaacag 369001
gctcgccagc ttctcgccag ccggcaccgc ctcgccggcc aggacccgcc gctccgtctg 369061
ggcaatgatc cgctcgacca gcggcttgta gcggcagact tgcgcctgcc agagttcgac 369121
cgccgggccc gccgtgagga gcaactgtcc actcgcctgc tgcagatagc tcaaggtggt 369181
gcgcgcgatc ttgagcagtt cgcggtagtg cttcacccgt ttcgggcgac cgcgggtata 369241
ttcgatcgct cgagcccgct tcttcgccgc gcggcagtga tcgtgccatg ggatggcgcg 369301
acccagtgca tcagcctgct gcaacagtcg caccatcacc cggacagcgt cccataacag 369361
gctgctgtcg ctcggctcat ggatcggtgc ggcggtgacg gtgctgtcca cacgcacgac 369421
cttgccgctt tccagtttct cctgccgggc gctcgccagc agcacccggt tgatctcttc 369481
aaaggtttgc gcccggatcg ggctgattgt cttgtgcaag accgacttct tcgggttcca 369541
cccccacggc aaccgggcaa aggcccggaa agaggcggag tcttcgaaat ggaaggccag 369601
ttcctgatag atcctatgag gagaggtgga tagcgatccg cgctgtgaca aagtgatgtc 369661
gctttcaatc aacaccttac tctggagagg ccgaacatgc tcgctgcgaa tgaacgacct

Figure 3 (Cont.)

369721
gaagcgccga ccgctatccg cattgatctt ggcgcaatct tcgtctcctt ggaactcagc 369781
cgttcgaaat ggctaatcac ctcgctgtcg ccgggcggcg gcgagaagat gtcgaaacat 369841
gcggtggcgg ccgacgacat cgccggcctg ctggcgcggt ttgccgagct caagaggaag 369901
gcgcgggccc ggaccgggcg ctactttccc accatcgtga tccaggaggc cgggctcgac 369961
ggcttctgga tccaccgggt gctgcaggcc gaggggatcg aaagccacgt cgtcgatccg 370021
gccccgattc cgacctcgcg ccggcggcgg cgggccaaga ccgacaagat cgacggtgag 370081
acgctggtgc gcgcgctgct cgcctataaa aggggcgagc cgcgcgtctg tgcgatgctg 370141
cgggtgccga cgcccgagga ggaggaccgt cgccgcatct cgcgtgagcg caaggcgttg 370201
acgaacgagc gcgtacgcca cgtcaatcgc atcaagggcc tgctgttcag ccagggcgtc 370261
tccggctacc agccgctgcg ccgcgaccgg cgcacgcggc tcgaggagct gaggaccggc 370321
gacggccgac cattgccgac gcatcttaag gcgcaggtcg gccgcgaact cgatcggctg 370381
gagctgctga tcggacagat caaggcagtc gaggtcgagc gcgacgccat gctcgctgcc 370441
gcgccggtcg gctctgcgca tttcgctgat tgtgagcagc cggcaccggc gatgctgctc 370501
gccttgaaag gcatcgggcc ggagtttgcc gctgtcttgt ggtcggaggg gctgtcgcgt

Figure 3 (Cont.)

370561
cattttgaca accgacgaca ggttgccgcc tatgccggcc ttgcgccgac accctggcag 370621
agcggctcgg tcgatcacga ccaggggta tcgaaagccg gcaatccaag gctgcgaacg 370681
acgctgatcc agggggcctg gctgtggttg cgccatcagc cgcactcagc gctcagcctg 370741
tggttcaagc agcgggggaa gcagaacgat ggtcgtctga agaagaagaa gacgatcgtg 370801
gcgctcgcct gcaagctact cgtcgcgctg tggaaatacg tcaatgccgg cgtcgtcatc 370861
gagggggccg tgatgaagac cccctgatcc cgatcgcaac cgaaattctg caatcttcca 370921
ggacccgatc agtcctggcg gatctaggtg ggacgaaccg cagttgagta tggcttcaaa 370981
cgccgcttga tagaatggtc tcgtcctcct gagcccttgt ccgccgcaag cgggatgttg 371041
gttccgctgt ctcgaacagc gaccgtatat aagttggatc tggcttggca acgagccgcg 371101
tcttgcaatc gggctcagac cgtggatgcc gcaacaaccg atggaaagca aaaaaagtca 371161
ccctgacgac agttccacat tgacgctcct catataaact caactggcga tgctgcttga 371221
gcagcgcgca gcgcagcaca gcctcggccg gcagcccctc gcggccggtc tccttgaggc 371281
catgccggcg caggtcccgc gtcaccagcc cgagcagatc gcgatgctca tccagccatt 371341
gcgacatcac cttcagttca cgaccgatct cgtgttcggc gaaaagatcg aatatgctcg

ccttgtcaag cgaatcgaag aattgacccc ccctattgcc tcacccagga atgttactga 371461
agttgggggc attgagatac gggcgcgcgc ttcatccagt cgccatcgag tatgatctgc 371521
ccggctattt ccatgcgcca agccttgacg gccatttgca ccgtccgcag cgctttcttg 371581
gtgaagcgtg acggatcggc gctcacaagg cgctggagca ccgcggctgc cgagagcgcc 371641
ggatctgcct caagccacgc tcgaatctgg ggctcgaatg gctccagcat gctcggcctt 371701
ttcgggtaag gcttggtccg ccgatagggc cgccgatgtg tcggccgttt ctctccggcc 371761
tgccaggctg tcttcaggct cacggtgaat cgctgcagat cgatggcgag cggttcttcg 371821
gtcccggcat tcaagccacg gcaatcgacc cgctttccga gctcctcctg ggcggcacga 371881
attccggcaa acagcatcac cggatcttcc ctttccaaca tcgcctgcag ccgctcctta 371941
tcggcctcgg ccacaccgga atgggcaacc accccgcgcg ataggcggca cgggcggatg 372001
gtagcgtttg acgacgcggg cgccgatccg tgtcttctct cgcagcttga acgaaggctg 372061
gaacagattg ccgtagagac gcaccacgtc gtagagacgc ccaagggcag ccgtcgcctc 372121
cgcgccgacg agccttccgt aaccgaccag ccgtcgcacg atcgcgccgt tcttctgctc 372181
gacccaagcc tgatcgttct ttcgatacgc gcgcgaacgg gtcacctcca atccctgact 372241
tcggcaccag cagaccacac gttcgttcat gaaggcgcta tcgttgtcga agtccacgcc

Figure 3 (Cont.)

372301
ctgcagcggg aatggaaaca gcgagcgggc ctgattgagg gcagcgataa cgagaccgct 372361
ttcgcgcgtg cggactggca cgcactcggt ccagcccgta gcgatatcgg ttagcaccat 372421
cgtctgcacg aaactaccgg acgaagaggt ccccgaatga gccacgaagt cgacctcgac 372481
ataaccgggc agcggatcgt tccagtcccc gaaagtgcgc accgggaccg agcggcgaac 372541
agcagaactc attccagcgc gccgacgctg gccaccacga gccaccacac gtatctctga 372601
cagcaaccgg tccatcgtcg ccgcactgac ggtcagtagc ttatcgcgaa gctcggtact 372661
cagatcgagc cggccgtgac gctcaagagc tggcagcaaa atcgggatca gcggcttcag 372721
acgtttcgag cagaggcgat cggatgcttc ccacagagcc accagcgctt cccgaacctc 372781
gggaccatac ctgacagcat attgccgagc gcaaggcggc tcgctctcac tagggcggag 372841
cactcggatc gcatgcttgc ggtgatatcc ggtaactgcg acgaactcat ctaggatcct 372901
ttgcttgtcc gcccgacagc tcgatcgata tcgttcgatg atcgcctcga ccagttccgt 372961
ccgtgtcgcc atgctgatcc gccgtgccat ccatcccccg agccggaaca gcgaaccatg 373021
gccatcccat cgggagcatc aacactatcg gtaacatttt gcttgaggca atgcggggtc 373081
aatttttcat ttcgcccgac acgcctggac ggtgcgttct tggcgcattg tcggctccgg

Figure 3 (Cont.)

373141
cggttacggg tttatcttta gaatcagtag cttgatctaa agtatacctg aagccgccgg 373201
gctttgcccg ccgagatatc gtgattaata caataatttc agcagtttaa cgtttatgga 373261
cgggcactag tctagattag accgctgcat tcttccgacc ccatggtggg agggccaggg 373321
tgccgatccc cgaaaagaaa aaagaacccg cggagaccat ttcaacgcta gccggaacgt 373381
aaagctcaaa agcgcttgac cacaaccgcc gaatagagaa gtgctcgcac caggagttgc 373441
agccttcagg tcatccggcc ttcaccgtgg gataccgtca gcctcgcgca agcgacgatg 373501
tgctgagcca gtgcgcatgc gtttgtcacc actgcccatt tatagcgctg aggtttgcga 373561
catcccgcaa cggtacgtta ggccaccggc gttgcatcgg gagggatgga gagggttgca 373621
atcgccgcaa gcacagatgt gatgcccgcc aaaacgaata tagccgacaa cgattctgtg 373681
atcactaccc cagcaatggc cgctcctagt gggaagcccg cttggtttac gcttatcgaa 373741
atggacatca ctcgaccaag ctgtcgggga ttggtgcgcc gttggcgcaa ggtcagcatc 373801
gcgacatcaa taggaccgga cattgcgcca gcgagcaaca ggccgatcgt caggccacgg 373861
aagccgaatt ccgctgcaat gggccacgtg gcaaaagcgg ttacggccat tccggcggtc 373921
ataatgtggc gctcgcgccc agtggtgcac agatgtccag cgaggagcgc accaacacct

ccggcgatac cgaccagagc ccataaaagc cctactactg tactgcccgc cgcaacagtg 374041
tagttaccgg caacgaacac cggaatgacc acgtgaaggg cgccccatgt catttgatac 374101
agcgactggg agacggccag accgcgtaat gtgggctgtc ggaccaccac ataaatgcct 374161
ttgatcgctt ggcgtagcaa agatgtgcgt gaggatgcca gccctggcag gcgctggacc 374221
tgggataagc agaccgcggc acctgcacag gccgcagcga ttagagacat cgcagcttct 374281
ggcccgagcc atccgacgag tccgcccgcc atcgccggcc ccaccacatc gacgatggaa 374341
tagaccgcag tgtctagcgc attcgcctga tcaagcgcgt gtggtggaac gagtcggggc 374401
aacagcgtgc ggattccagc aatgcctaag gggccggcta gcgaaaatag catcgccagg 374461
gtgcatacga ctggaggact ggaccaacca agccaaccgg caaggctaat cgcggtaatg 374521
aaggcagtgc tagcgatcat gtcgatcctt actgcgattg tcggtcctac gcaatcaagc 374581
aaaacacctg cgagcggact tacaatcagg cccgggacaa ttgctgcaaa tgtaagccac 374641
ccagccagaa ctggtgacga aaaacgcgcc agcgcgaaca gcaccaatgt gaggacgaac 374701
atgcgtccgg ccaggcggga caaggttgca gcaagaagca aggagaatag gccaggtatc 374761
ttcgaaaggc ttctgtatga aatttgtcgt tccatggtga cctgcacacg ggcgctatgt 374821
tggttgcagt ttacgagaca tccggacgtg ttactggggg gccgggtcct ttcgagcaca

Figure 3 (Cont.)

374881
cgacaagtcc aagagcagcg tatccgtagc cgccgacacc ttcccgcatc agacaatcgg 374941
cactgctttt ggccgtgtcg ccagtctaac aagtcgagtg tctgattctg tttatagact 375001
cgctccgacg gcgtgccgca tgattaaggc tgaaaatgaa aacctcctcc agcgatccag 375061
gcggagcacc cgctcgcctc cttcctaaga tataggcatt gatggaaatc gaagaatagc 375121
ccaacacgat actaccaacg taaataggtg cacgagatgg cgctctatgc tgagactctc 375181
cacgaagctc agtgcgatta tgcctttgtt cacgttagtg gcggtgccga ccacatgctt 375241
atcttctcgg tcagcatgat caaagtttgc acgtgatctg gtaatgttag cccccgcaat 375301
gcgagttgaa gaatgcccaa cgtccagagt ttagcgatta ttgtcactga cccgcgactg 375361
ataatctcga cttggaaaga tcgctgtcca gcgccgctga gctcggtcgg cggcatgcca 375421
attcttgccc gcttggtctc tcaattggca caggcggggg tacaaaaaac gatcgtgttc 375481
gcattagatg gtatcggcga cgttaaacgt attctcaaca accgcatgaa gcgcatggag 375541
ctcgtgatac gtatcatgcc gaccccgggc tctggtcgcc ttatagatct agcaactatt 375601
acggaaatcg ctgagttcca cggtcaagtt ttagtgttca ctgagaacgc tgtcatcgat 375661
ccctcactga ttcaacgttt attgcgatca tctgaccgca atatcacggt agtaagcaga

Figure 3 (Cont.)

375721
tcagaacgca gacgatgctt gcgtttattg ggcgatattg gaggccgtct tactgccatg 375781
ttgcccggtg actctcccat tcgagaaagt gcttctgcag acgttagccc cgtcgggatc 375841
tataaatttg atcccgcact tctccgagcg attgctcgta tccgccccca tcggtttaat 375901
gacgatctgg agttcttcga aaccgcttta gggcttcaac gccatcaaat ttacttgatg 375961
tatgccgacc ctcaacacgt aaggagagtg aatgatgcca ccgatcttga ggcggcaaat 376021
tttgcgtcta gttccagcgg cgaccagttt agtatacttg aacgattgca agcggggaac 376081
tggcgatatc cagccagtga gcacatcttg ctctgtaatc atcattttcc tccagcctca 376141
gtagtcgacc gactgcgcga acgtttgcag gacctgctct atcttcagcc ctccgaccag 376201
ctcgatatta tagcaaagct ctcggaaatg acagatcttc cggctcgaaa tcttgcagtt 376261
ggtaacggcg tgggcgagtt aattaaagcc ctctacggct acctcgatcc gagaatcgtg 376321
attccaaccc caacatccgc gcagtacatt gatgccgtcg aaccaaataa agtgagtcgt 376381
ttcgagcttc cgcctgagaa ctttgactta gacgtggagg ctttcgcaaa ttttgcaaaa 376441
aggcggcaag cgtccgtcgc tgtactggtc aacccaaaca acccaacagg acgcttggtt 376501
cccgtccagg agatagaatg gttggcgtca caactcgcta tagagaagtg ccggctcgtg

gtcgatgaga cgttcataga gttttcagtg gcagggaaag gaaattcggt agagaagctt 376621
ctcagcgttt ttccaaagat ggtcattctt aaaagcctag gtgcgataat gggcctggga 376681
ggtgcccaga tcggctatct tgcttcgaaa gacgaacaac tcacccacgg agttcgccgg 376741
cggcttccgc ttgggaacat aaatggcatc gcagaatatc tcctttggat tttgccagaa 376801
tttcgcgagg agtgggaagc aagctttcgt cgcactcgag cagacgttgt gtccttctct 376861
cgaatgttgg atactatccc ggagcttgag gtccaccctt cccaagcaaa ctacctcttc 376921
tgcagaactc ctgaggcttg gccaagtgcg aagcatgttg ccacgatgct tgcgaagcga 376981
tacggcgtgt tggtccagaa ctgtgaaaat cagtgtatga agtatggtga ccgatacctg 377041
cgcttgactg tgctaccta tgaggagaat cgttaccttg tgtcggcact ccggcggatt 377101
aatgaagaac tggtagaatg gtcgacacaa agtaagcgcg cgggtacggc gtatcatttg 377161
gggtgctgat cttgaatttt ctgcatgagt catgcggaga atcctatgag cgacagtgtc 377221
agtcagccgc gaacattcga gcttttgacg gcggcgccgg tgcgggcgcg acgcaagccg 377281
cgggaccggc cggacgagga gaaggaccgc ctgattgccg agacgttgac ctgcccctg 377341
gaatgtcccg ggttcgaggt tggtctgttc tccgaagatg gagacagaga acgcagcgat 377401
cccgtttcga cgagcagatc atcggcattt tgcaggagca ccaggctggt ttgtcggccg

Figure 3 (Cont.)

377461
tcgagctgtg ccgcaaatac ggtgtcaccg acgcgacctt ctacaagtgg cacacagagt 377521
atggcggcat gtaggtctcc gaggcgaagc gtctgaaggc gctcgaagag gagaatgcca 377581
agctgaagaa gctgctggcc gagcagatgc tggatgccgc cgcactccgc gagcttcttg 377641
caaaaaatgt atggtccgcc tcgtccgtgc aagggtacgc gacatcgtga atgacaattc 377701
cagttgcata aatgtatccg ggcctctcgc gagtgggctg cggttgcagc caggccatga 377761
gatccgcaca tgccgttccc aataaatggt tcgggcacga agcccgcttt tttgaacagg 377821
acttatacca acgagcggtg atcatgaccg atgcgcccat tcgcggagtc cgatggacat 377881
gatcttccac ggctggtcga cgagcttgtt ccatgcggcg cagcaatggg tgacgatgtc 377941
gtcgtagtcc ttgaagatac ggttggagag ccagttgtcg cgcatgaact gccagacgtt 378001
ttcgactggg ttgagttccg gtgagcgcgg cggcaggaac atcaaggtga tgttgtccgg 378061
caccttcagt ttcggcgtca cgtgccatcc ggcctgatcg aggatgagca ccgcatgggc 378121
gccgtcatcg acgctccggc cgatctcggc gaggtgctcc tgcatggcct cggtatcgca 378181
atagggcagg accaggcccg cgccctttcc cttccgcggg cagacggccc cgaagatgta 378241
ggcccacata tgtggacggc tcccgcttgc aagtgttttc tgcagatatt tttgaccgga

Figure 3 (Cont.)

378301
tcgcttgctt ccatatgtgc ggccttttgg tgtggtcgca catgaccact ggccaagatg 378361
atttccgcaa cgcgtattcc taacatggtc tcgaccttta gcggtcagtg ggcctaacgg 378421
agtttcacgc gtcttggatc gtccgatcgc atcatctgct cttcgcttgc aagttcacag 378481
catcagctca cacggtagca ttttgtcttt gctcaccgtg gtggctgaac ttttatgatg 378541
tctgcgcttg gccttctgcc tggcgatatg actcgccgct cgtcataagc ttccacgcaa 378601
tccgcgccag cttgttggcg agcgctacgg caaccaactt tggccttttc cgctgcagca 378661
gccccataag ccatgcagag gcgtgcctgc tgcggcctgt tctgacttgc tgtagaagag 378721
atgtcgcgcc aaccaccaag atgctccgca acatttcgtc gccagcccgg gtaatgacac 378781
caagcctgac ctttccggca gttgaatggt ccttcggcgt cagaccgatc catgctgcaa 378841
agtcgcggcc cgatttaaac attcgaggat ccggtgtctt catcaagaga agggaggcgc 378901
ctatcgggcc gacacccggg atctcggcca ggcgtttgct gcattcatca gcacgatgca 378961
acttcatcaa cttttcatcg agcgttttga tctggcaagc tagctcgcgg tattcctgtc 379021
catgcagcgc gaagagatcc tgcgccagtt ccggtaggga cgggtcagcg gcaatgcgct 379081
ccaatagcgc ttcgatgcgg cacatgcctt tggccgcaac gatgccaaat tccatggcaa

aaccgcgaat ggcattggcg agctgtgtcc gattgcggat gagtctctct cgcataccga 379201
ccagcattaa cgccgcctgc tgatcagccg ttttcattgg cacgaagcgc atggtcgggc 379261
ggctcattgc ctcacacaat gcttccgcat ccgcggcatc gttcttgccc cgtttcacat 379321
acggcttggc cagttgcggt gctatcaact ttacttcatg gccgaacgaa cttaacagcc 379381
gtgcccagtg atgtgaccca ccgcacgctt caagtgcgat aatggtcggc ggtgttttct 379441
cgaagaactt caccatttcc cggcgcgaca gcttcttacg aaggattggc tgctcaaccg 379501
cattcacacc atgcaattgg aagacgctct ttgacgtatc cataccaatt cggataatct 379561
gttccacgga cggtttccct cgattgagaa cttcaacgaa ctcattctgg cacattcgat 379621
gccgttggga gccgtccacc tcaacatggt gcgctgatcc aagggcgcgg atggtctggt 379681
gccacgacgc gcccatcggc gcgtgatctt gttcttctgg cctatgcgcg cttcgtcggc 379741
ccaccagagt tcgatgtccg tgccttgcgg gagccggctt cggatttccg ccagagcggc 379801
ggggaagtct ttttaaaagc gtctacttcc agctcgttct gagcgtagtg gcgtgggcga 379861
gccgacagct tggcaaagcc gagcgccttc aactcgcggc cgaccgtcgt ctcgtccatc 379921
gagatgcgga attcctggaa tatccactga accaggtcct tgcgccgcca acggacaaca 379981
ccgtggatcg ccgggatcgg gccgctctcg acgacctttg caagagcctg gcgctgagcg

Figure 3 (Cont.)

380041
gcattcaact tcgctcggcc gccaggcgct ttgccattca ccagtccatc ggggccgcgc 380101
gcgttgaaac gcaggaccca atcccgcaca atctgcagcg tcacgctgcc gatccgtgcc 380161
gcatccgagc gcgggccgcc gtcatagatc gcggcaagag ccagcaaccg ccgggcctga 380221
ttggcatcct tcgtctgccg tgcgagctgt cgaagagcag ctccgtcgaa atcatcacgc 380281
aacaaaaccg ccgaacccat cgcaaacctc ctgtttgcag catggattca gattcgcgac 380341
accttgggaa tcccatgaga gtcagaaacg gcgctcgttg gtattacggc atgttgatcc 380401
actgtttcgt catcactatt cccgagcctt gcaatcgagc ttggatcgcc aggtgaaggc 380461
agggtctctg cgttcgtaga gcgctccagg cttgatcagg acgacccaga caatccgggc 380521
catcttagcg gcaagtgcga cgacgacttt gtagggtgca tccgagtttg aaggccatcc 380581
agccagttcc ccaatcgatc tcttgttcgg tcgagatgcc gaaagcatga tcgtgcgcca 380641
tgtacgagca gtttgcgcac gtagcggttt cctcgtttgc tgatgccgag aagcttctgc 380701
tttccgccgg tcgagtattc gcgcggcaaa ggcccagcca cgcagctaga tcgcgggctt 380761
tttggacttg ccgaccgttg ccaatggccg cgaggagtgc agtcgcaccc aaagctccga 380821
tcccggggat cgtcatgagc cgtcgagcca catcctcgcg actggcgatc gcctcgatct

Figure 3 (Cont.)

380881
cgtatagcgc ggcgatcagg atgagacggc ggcgacaatc tggatgagac tcttatgtcg 380941
cggtcggcat gaaggtatca tgttgattgt cgctggcaag ggtctcatcg tgttctgatt 381001
gtcgctccgc gacaatcagg gaagcacttt tggttgtcgc gaaggcggcg ggtctgccgc 381061
ggtggcgttt ggcttccatg gcggaacgtc gccgatagct ttcgacgttc atttcgaaga 381121
tcgttgcgtg atgaacaagt cggtccaccg cggcaagcgt catggccggg tccggaaaga 381181
cgcggttcca ttctccgaag ggctgattgg cggttatcat gatggaacgc cgctcatatc 381241
ttgcggagat gagttcgaac agcacgctgg tttcggcctg gtccttggtg acgtaggcca 381301
gatcgtcgag gatgagcaga tcgaacttgt cgagctttgc gatggcggat tcgagctgga 381361
gttcacgccg tgcgacctga agcttctgga cgaggtcggt cgtgcgcgtg aacagcaccc 381421
gccaaccatt ctcgatcagc gcgaggccga tggcggcggc gagatggctc tttccgccgc 381481
ccggcggacc gaacaggagg atattggcac ctttggcgag ccaactgtcg ccggcggcaa 381541
tggccatgac ctgggccttg gagaccatgg gcacggcgtc gaaagcgaag ctctcgagcg 381601
tctttccggg cggcagatgc gcctcggcga ggtgacgttc gatcctgcga tgcgcccgtt 381661
cagccagttc atgctcggcg atggccgaaa ggaaacgagc cgcaggccac ccttcacgat

cggcctgttc ggcaaattgc ggccacagcg ttttgatcgt cggcagcctc aggtcattga 381781
gcatgatgcc gaggcgggct tcgtcgatgg tgttgtggac gtttttcatg cggcctctcc 381841
cgcataagca gaccccatca gggcttcata gctattgagc gatgcgagct gcacatgcac 381901
ggtcggcaac tgatccgggt ccggaccgaa gatggctctc aaggccatca ggtcgggcag 381961
tttgcgggcg tcgagcgttc tggcaagctc ctcggccagt tcacgctcgc aaccgcgatc 382021
atgagccagg gccagcaatt cgacggtgat cttgcaagcc tgccggtcag gcagttgctc 382081
gatgagagcg tcgaaagccc tgcgatattc cggccggggg aagagcttgt cgcgatagac 382141
caggttgaga agcgccatgg gctttttgcg cagagagtgg atgacgtggt gatagttgac 382201
gacctggtca tgcttgccgc tcgcgtgggc gcgacctcgt ggcaacgtca gcagatgcgt 382261
gccgccgatg aagacgtcga gacgatcgtc aaacaaacgc acacgcagcc gatggccgat 382321
caaacgggag gggacggtgt agaagacttt gcgcaaggcg aagccgccgg tgcgcgacac 382381
ggtgacgact acctcctcga agtcggtggt gcggcgctcg ggaagcacct gcagatgcgg 382441
gcgctcggca tcaatgcgct tgccatgcgc ggcattgcgg cggctgacga tctcgtcgat 382501
gaaggcgcgg taggagcgca gatcgtcgaa gtctctggtg ccgcgcatca ggagtgcatc 382561
gcggactgcg ttcttgagat ggccgtggga gctttcgatt gagccgttct cgtgggcgac

Figure 3 (Cont.)

382621
gcccttgttg ttgcgcgtcg gcgtcatccg gtagtgagcg cacagctcct catagcggtt 382681
tgtcagatcg accttggcat cggcatcgag gttgcggaag gcagccgaca ggctgtcgct 382741
gcggtgatag agcggcgaac cgccgaccga ccacagggcg ttctgcaggc cctccgccaa 382801
ggcgacgaag ctttcgccgc caaggatgac atgggcgtgc tcaaaacccg accaaaccag 382861
ccggaagtga tagagcagat ggtcgagcgg ttggccggcg atcgtcacgc tgaggctgcc 382921
catgtcggta aaatccgaca gccctagtcg gccgggctcg tgcgtctggc ggaagatcac 382981
ctcctgtgct tcaccgtgaa ccgcccgcca tgaccggatg cgccgctcaa gtgtgcggcg 383041
aatgccttcg ggcagttccg gatgacgccg cagcatctcg tcgtaaacgg cgaccgcacg 383101
aatgccggga gcggccttga ggagcggaac gacctccgca tcaaagatat gctcaagcgg 383161
atcgggtcga cgccgaccgc ggggcggctt gttctgcgac ggaaggcgct gctctttctc 383221
catgcggaac gccgtcgccc ggctgatcga cgccttcgcg gcggcgacct caacagaatg 383281
cgtttgtcgg tacttcatga ataatctcat ctgatgatcg gttacatggc gacccggcac 383341
aaaggtggtt ctccattcca gaaaaccgcc accgtagcgg gccgaccgcg atcatgagac 383401
gcctaaaaat tgcgccgcgg cgggggtgta actccggtcg ggctacgccc tcccttcgtc

Figure 3 (Cont.)

383461
acaccccac cgccgagtct catcctgatt gacgctgagt ctcaccttgt ttgtcgccgc 383521
gcaatctcgc gtgtgacgtc accaatgcgc ttctccaatt ggcgcagatc ggtgaacagc 383581
tctgcgagca gcttacgcat cgccgacgaa aggtcgtttt gattggtcct cgagaaccag 383641
tggcaggtcg agcttgaaca gacctgcgcc ctggcgtagg gcgaccccgt gttcgaggca 383701
gaaggctcgc atctgattga tcagacgcgt tctcgttccg atcatctggc cccgcacccg 383761
atgcaaagcc cgaagatcgg cttgttcctc gctcttgagt gcagcaaatc gcatcgttgg 383821
tcgcgtggct gcctcagcga tcgcctccgc atcgatgata tcggttttgt tcgactttac 383881
gtagggcttc acaaactgcg cggggatcaa gcgcaccttg tgtccgagcg cctgtatctt 383941
cctggcaatc caccgagatc ctgcgcacga ttccatcccc acgatcgccg gtgctgcgcg 384001
cgcgaagaac tgtaacagcg tgtcgcgtcg gaaaccaacc ttctggactg gcacgccatc 384061
gctccgaggc cgacgacgtg gaatatactc ttgccgatat caattccgta gacagccgct 384121
gggcgcggca gattgcgttg tggtattgca acctccttcg gtttgacagc ctcagaatgc 384181
ggcaggagga caaggcggac catcccatta atggtagggc ctgccgccaa gcgtgaagcc 384241
ggcgcgcatc tgaaggccgt catgggtctg tcggagcggc gggcctgcca gatcatatcc

gctgaccaga aaatggtgcg ctatcggtca cgccctataa cttgaaccgc ccgcacacgg 384361
tcctcaacgg cttgacccca aggagcagaa ggctggcgcg aaggtggccc gacctctgca 384421
gcatgggatt tcagaagcaa cctttacaac tggaaagcca aatacggcgg catggtgctt 384481
tccaaggcga agcggtctct tggccttagc ctttcgtctt ggcccgctag ggacggcgtg 384541
ccctaggatg aagatcgtcc cctcgcactt gtgttcagct ttgtccgttt gagacttcca 384601
tgtgcgaaac cccagagact gagggcgggt attccgtcgg cgtggcgcga aaaaacgtaa 384661
gttttctccc cttgttctca ttcgttggca cgccgattgc attggactcc gtgtaagcgc 384721
gtgggatgag accaactgtt accctcgatt agcgaccaaa ttcgagcaaa tgagagtgac 384781
agttaccaga caaccaagga gtagctcatg cgaatagccg tcgtgtgtaa cagtgctttt 384841
acgggtgtaa tcaatcggtt cggtcagcct tatccgcagc cgccgcagcc ttggccgcag 384901
ggccggatag cggacagcgt ggtggcggcc ctgcaagaat gcggccacga gacgctgctg 384961
tgtgaaggcg acaaaggact gctcactacg cttgagcggt tcatgccacc cgatccgcta 385021
gcccgtactt cgggaatggt cttcaacttg gccgagggaa ttcagggcga gtaccgtttc 385081
acccatgttc cggctatgct cgagatggcc ggcgtcccct acaccggatc gagccctctg 385141
gggcatgggc tgaccgacga taaggtcatc agcaagacgc ttatgcgcga tagcggcgtg

Figure 3 (Cont.)

385201
cccacgccga actttagtat tatgcgccgc ggcaccgaga gtaccgacga tctccgattc 385261
ccagtcgtgg tgaaaccgcg tcacgaggac aacagcttcg gattgcagct cgtacatgag 385321
ccggctcaat tgcagcaagc agtgaaaatg atcgtcacga agtatgcgca ggatgcgctt 385381
gtggaagaat acatcgatgg gcgagaaatc cacgtcgcgc tgttgggaaa ccaagaagtc 385441
gaggtgttgc ctatggtgga atttgagctt ggcgaacacg aagcccctct tctaacctgg 385501
gaagcgaagt acttggcggc cgtgcagccg ccaaagacct gtccggcgaa aatcgagagc 385561
aagctcgcga ctttgctgcg ggatatttct gttgcgacct tccgcgcctg ccagtgccgg 385621
gattatgctc gcgtcgacct ccggctcgac cgttccggcc agccctttgt tcttgagata 385681
aactcgatgc cgggactcag tactcactcc gcttatgttt tagccgcgat gactgccgga 385741
cacagttact ctagcttgat caatggcatc ctcgacgtcg cccataggcg gtacttcgga 385801
aacggcatcc tagggtgagg gtggttcagt catcatagcc caaagatggc ggcaactgcg 385861
atacagattt ccgaaaaagg tttaggcgta tcggtcgcag cagctgtcaa tctgatccac 385921
gcattagcga gtgtcataca ggaatgatag ctgcatgcgg ctcggtacgg cggatgcccc 385981
ttgtctcgat gctcttgtcc cgatcaagcc ggaaagcatg gatgaagtcg acggctaaga

Figure 3 (Cont.)

386041
gttcatgaac gtcgccgcgg tcgcggtcgc gcacaaaacg acacgcgccg taggaacagt 386101
gcgggtttgc gaggagaggt gaatgtgacg acaaaccggt atggtgcggt ttgggaaaca 386161
ccgatgagac gatgcaaaag agctcgtccg tttgactggc ctccgatcgc gaataccatc 386221
aaggcctgcg gtcaagcagc tcgcacaaac atgccggaaa ctgaccgcaa gcaccgtgtc 386281
tgccgtgatg ttcaaattac acctgtaaac atggagagat tcacactcgt ccctatgccc 386341
gatggtcgtg cggtggcttg ccacgtacgg gccccggctg ccgcggctca tatttcgccg 386401
agcgctctcg cgtctcttgc actgccaaaa accgttcagc ccggcggaac aattctcgcc 386461
cgtcgttgaa tcaaaaagct agcccagaac accaaggaag aaatatggag aagtgctcac 386521
acgagagcgg tcgtcattcg gcggagaatg acggcaaata cgatatcact ggttcgacgg 386581
cgacgaacgt cgtggacggt ttcacaatgg tggcagttgg cgacgttatc gtgtcgcgaa 386641
ccctggcgaa cgggcaccat ccgggcttta gtgagatcgt cgagctcctg cgagccgcag 386701
acgtaacttt cggcaacatg gagacgctga tcttcgacat cagatcattc aatggaacac 386761
cgcaggctga gtacgggggg gcgtatcacg tcagccttcc cgagattgga cctgatctga 386821
aggcgatggg gttcaatatt atgggccgcg caaacaacca ttccttggac tggggcgtcg

aaggcatgcg tgagacgagc cggatcctcg atgagagcgg catcatccac gccggtgtgg 386941
gtgaaagtcg cgcacaagcc agcgctgcac gtcttttaga aacggcccgc ggtcgcgtcg 387001
ctttgctctc atgcgccacc tcattcacgc cgatgtcgcg tgcatgcgat ccagcgggcg 387061
aggcaccagc caggcctgga gtcaatgcgc tccgtctaga gagaagcgtc gtcgtcgagc 387121
ccgacatgct tgagagccta agaaagatac gtgatgcctt gcccaatcct gggcctaaac 387181
acgatgatcg cgaaatgttg gtgctcgcag gaacgaccta tagaaccggc aaagacgtcg 387241
gctacaccta tgcggctaat acgcgagatc tggccgatat tttaagaaac gttcggcgcg 387301
gcaagcaata ttccgatttc tgcattttta caaaccacgc acacgagccg ggaaattgga 387361
gcgaagagcc ggccgatttt gagcaggcgc ttgctcgcaa gctaatcgat gcgggagcgg 387421
acgcgtacgt tggacacgga ccgcaccgac tgcgtggcat cgaaatctac aaacgccggc 387481
ccatcttcta tagtctgggg aacttctttt atgatgacct ccggacaccc gttggggcgg 387541
acatgtacga tgtgtacgac aaggacccac aggtggacac cgatgccgaa gtaaccgcag 387601
cggaagaaac aatgggttac cctacggctg cagggttcat aggcgcgctc gccgaaccgg 387661
tgtattacga gagcgtcgtc gcagttagcc gctttgagga gaaccaactg gccgaactgc 387721
ggctttatcc aatcgagctc ggttattcca aaaggcttgc gaacaggggc gtccctagtc

Figure 3 (Cont.)

387781
ttgctccacg ccctcaggca atctcgattc ttgaacgcct gcagaggttg tcagagccgt 387841
ttggaacgag aatcaccatc gaggaccgtg tcggtcttat tagactgtaa ccacgcatcg 387901
tcacgaacct cccaagctgc gatttctcgc ccgtatgggg tcgctcttat cggctgagca 387961
gggaactgat aacagatggc tcaaggaaag cgatgttcca agccggtttc agttgacttg 388021
tagaactgat ccctgcttat cctcgttcgt gtagaaggaa tgagggagcg gtttggtgtc 388081
gctgtctgag agcgagctac atgccaagcg tgcagttgct gatgcggtac cgtaatctca 388141
tccgtaaacg ccatgatctg ccggctcaga atatccagcg aagtgcgtgc ataagcccag 388201
gccgttggca tcggacagcg gttgctgcga ctttgccaga ttagatagcg ccgggattgg 388261
ccacaagacc agattctgcc aatgcgcccg cagcgcatgt gcgaccatgg tgcgctggcg 388321
aacgagcaac gctcgcgcgc ggtggatcac gagaatgcct tgctgctcca ccgtcgtcac 388381
aggcacgaac cgcatcgtcg ggagccgcac agcttcgcag attgcttcgg cgtccagctc 388441
gctcttgcca cgcttgacac aggcatcaca taggagagcg ggacgctcgt gcccatcgcc 388501
gcgagcgtgc gaggccaatg atgcgctgtt ccgcgcgctt ccatcccgat caggcatgat 388561
ggtagcttcg agaagaaggg cagcatttgc gtgtccctcc ggcggggacc gacttgcgaa

Figure 3 (Cont.)

388621
gttccgcgtc tcccgtgagt ctgcgctctt aagagtggac ttaagagcgc actgagcaat 388681
tcatgggaca tgcagtttgc tgacggggcc agagcggcgt cggcgatggt cgttggaaga 388741
tcgcgcgcag atactggcgg aggccttcgc gccgggcgcg gtggtttccg aagttgcgcg 388801
ccgcttcgag gtttcgactg gcctgatcta cacatggcgg cggcaagctt tggtccagca 388861
ggccgagccc gccctttgtg ccagccaagc ttgttgactc tggcagcagt gatgcggtcg 388921
aactggccat ggcagtggag ttcccgaacg gcgtgaaggt gagaattggc tcagcggctc 388981
catgcgacct ggcagccgcg atcatgcgag cgctcaaatg atcaggccgc ctcgcgcggt 389041
ggcgccgact tcatccttgc gctaaatgca ggtcgtttgc gcagcatggg tgccccgtcg 389101
atcttctccc tgttggctct ccgcaacagc aacgatttcg tcctcgattt cgcccgatcg 389161
gagatcctac ccttcgccaa ggtcccgatc ttcttcggcg ccagtgcctt cgacccccgc 389221
tcctcggttg aagctgaact ggggaggatc gcggaagccg gcttcggtgc tgtcgtcaac 389281
ttcccgactg cgatcttcct caacggtcgc tttagggccg atatagagtg cgccggactg 389341
ggttttcagc gtgagctcga aatgctccgc gttgcccaag agcgcggcat ggcgacactc 389401
gcgtatgtct gcagcatgac tgaagcagag caggcggcag aggctggcgt ggacatcatc

aatcttaatc tcggctggaa cgtcggcgga tccgtcggaa gccgcagcgg gcttggtctg 389521
gcacaggcgg ccgagtacgc caagatcgtg ttccggcaga taaggggaat ttcccaggag 389581
atactgtgcc tgctcggggg cggcccgatc gttagccccg atcagatgta cgaggcctcg 389641
atcgtcgcca aggcagacgg ttatatcggc ggctcgacca tcgaccgggt gccgctcgaa 389701
gcctcgatgg aacggatcac atcagccttt aaatctgttg gcaccttgca aaagcgcatc 389761
gatgagctgg agcgaaagct cgagcacgtg cagcgggagt atttgactgt cgggcgctcg 389821
ccgttgatcc accagatcaa gcagcggatt gaaaagctcg cagcctcgcc cctgtcggtc 389881
atgattaccg gaaccaggaa ccggaaagaa gctgctcaca cgcgccattc atgaagctgc 389941
cagacgtcct ggcagcaaat taatcaacgc gcctacggcg gatgttattg gcgagtcgct 390001
cttcggttcg gccccggcgc agggtggacg cgaggtgctc gggctgctcc aattccatcc 390061
caaggcgacg ctggtgattg aggatttcga aactttgtgc gaagacgctc agaagcggct 390121
gaccgaggtc atcgagactg gcgtttaccg gcggcttggt gataacgaca gaggttttcg 390181
agggacgtct gatcctgaca tcgatgcagc cgctgtcaca acttagctca agcgggaagg 390241
taatctcctc gctcgcttcg cgcctggttc ccgggcatgt cttcctgccc aagctacgcg 390301
accgcctgga agacctgcct ctgcttgcgg agcacttcct gcaggcgctc agaaaggatc

Figure 3 (Cont.)

390361
ggcgcagcct caagctgtcg gtcgattact cggcctaccg ccttctgatg gcctattcct 390421
ggccagaaaa cgtccgcgaa ctgcgctccg tgctcgagac agccgccatc cgctgcgagg 390481
gcgattggat caaggcggag aatttgccgc ccttggacca cgcggatatg cgtgaatcgc 390541
acccggcaaa cgagcgcgaa tggatcctgg acgcgctcca gcgtcatcgc ttccgccgcg 390601
gtgaagccgc tcgccatctc gggatttcgc gcaagacgct gtacaacaaa atgcgcgcct 390661
atggtctgcc attgcagcca cgggacagcc cttaagctac ggccaagcga ccacgccgac 390721
tgtctattgc ggataaggcg gcagcaagcc atgacaccgc atctcagatg atgtggtctg 390781
ccaacagcag atgccaacaa tgacgcggcg tgctccgaat cccccggaaa aggacgttcc 390841
cccgcttccg aaaacggcga ctggtttagc aaaaaatggc gtaaggaagc ataatttctg 390901
cgagcgctcc ctcgataacg cacgatcacg cctttaattc gaatctagtc tcacacaccg 390961
attgcttcgg atggggggac gaatgccgct gttgaatgta tcgccattga agtggccgat 391021
aagtctaaag attccggcta tgaccgtctg cgtagcggta ctgtcctgca cgacggtcgc 391081
gacattcgcg ggaattactt cagtcgcaac aaccaggagc ttgatcgaga agcaccttaa 391141
ttatgtcgct atctcgatgc gagacgcgct cctcacaaaa ctccaggcga ccaagttcga

Figure 3 (Cont.)

391201
agtcgaaggg ctctccgcca atcctgggct gcttcaactc tttaataata cgagtgttgg 391261
tttcgcggcg gtgtcgccaa cagacctcac ggcagcgtcg gtagataaag tcgagagtgg 391321
gaagtttagt ctcgcggcaa caccaaccac gaaattctat gtcgacaatt atcaaaagct 391381
ggatgcttgg ctcaagccgt tggccgccaa gcagtcatat tcggggatcc ttttagcaaa 391441
tgctgagggc gcaatcatct atagcaccgg aactaatccg gtcggccccg tagatgccaa 391501
cggatcgatc aacttggcca tcgcaagctc agctaacagt caggaggcgg tgatgactga 391561
tttcacgcct ccaacgttgt ccgcaccggg gcaggctcta tatgccgttg cgatcgttca 391621
cccgttcata cctgacaaac gaaatggtac tctactgatt tccatgagta ccgaaatgct 391681
aaatgcagtc atgggtcaag caaagggttt cggcccacac agcgaagcgc tcattgccgg 391741
gagcgacggc aaacctcgct ccttgtcgtc catatccaga gacgaagacg ctgaagcggt 391801
cgtcaacagt gacctgctct cccaaggtat aaagacgtcc aatttcggcg ctcaagaggt 391861
tctttctgca tcacaacaac tgaaatggca ggatcaccag tggtcgatca ttgccctaga 391921
gccggaggca gatgttgtct cggcgtcaac tgcaatgttg atcaagatta tcggcattac 391981
ggctgccact gcgattctgg cgctggcaat ggccatcctc gcctctcgct caatatcagg

gccactggcg gggctggtgt ctattatgaa aagactcgca aacggtgaca taaacgtgcg 392101
tgtcgctggt gtcgatcgcc gcgacgagat gggcgaaatg tctagagcag ttctcgtctt 392161
tcgagataac gcgatagcta gggttgctgc ggaggacgat gcaaggagcg ctgaagaggc 392221
gatggagcac gaccgcagga tgatggagat ggagcggtca gagcggctcg acgagcaagc 392281
ccgagttatg gctcaaattg gcggaggctt agcagcactc tccgatggag tgtttagtag 392341
acccatcacc gtggatttcc cagaagagta tcgtccgctc aagagcgatt tcaaccgcgc 392401
actagggcaa ctcagagaga caatacgaac tgtcgcggct caagccgcgt cgatgtcgtc 392461
tatcgtctcc gaaataagct gcgcaactga tgtcctggcg aaacggacgg aacatcaggc 392521
tatcgtgctc gatggtgccg tgaatacgat ggatgcaata tcaaacgatg taagcgtcac 392581
agcgaacgcg gcaaataatg ctgatgcgct tgtccgcgac gcccactccg ctgcagccgc 392641
gtcggacgag attgtttcga gcgcaatagc gggcatgttg gagatcgaag agtcttctgc 392701
aaagattgca acgatcgtct cggtcatcga ggagattgca catcaaacga accttttagc 392761
actcaacgct ggtgttgaag catccagagc gggggaagcc gggaaaggat tcgcggtcgt 392821
tgcttcggag gtccgggcgc tcgcacagcg atcctctgac gccgccaagg aaattaagga 392881
cttgatcaat gtttctaccc aacgtgtgga gcgcggcaaa gagcttgtcg atagcgcgag

Figure 3 (Cont.)

392941
tgaattgctc aagcatatag ccgcgcgtgt cgatctgatc aggaccacgg tttccaacat 393001
tgctgcaacg gcaacgagcc aagcaaagca tctgtctgaa tttcagacta cgatcgctga 393061
gattgatcaa tctactcagc agacagcggc gatggccgag gaatcggacg ccgcttgtcg 393121
atccttgaac gccgaggcgc agcatctgtt ggaactaatt caacaattcg aactgggagg 393181
gggttcttcc acccgacagc ctcaaagccc gcccacacag agatacttca tgtcgaggta 393241
gtcttccagc ccatgcctgg acccctcccg gccaataccc gattgcttga cgcccccgaa 393301
gggcgcggcc tcggatgaca tccggccggt gttgatcccg accatgccat attccagcgc 393361
ttctgccacc cgccaaaccc gcttcaggtt ggaggcgtag aagtaagctg ccagaccata 393421
gatcgtgtca ttcgcctcgc gcacaacgtg atctgcatca tcgaaccgta acagaggtgc 393481
aagcggtccg aaggtctctt cctcagccag acgcatcgtt ttagaaacat ccgtgacgac 393541
cgtcggttcg aagaacgtgc cggatgatcc agttcgacgg ccgccactgc gaacccttgc 393601
gcccttctgg acggcatcgc tgatgtggag ttcaatcttt ttgagagcct cttgattgat 393661
caatggaccg atcgccacat tcggatcaaa gccgtcaccg accttcagag tgcgcacccg 393721
ctcggtgaac ttttcggcga actcggcata gacgccggat tgaacataaa tccggttggc

Figure 3 (Cont.)

393781
agacacgcag gtctgtcccg cattgcggaa ttttgcctga atcgctccgt cgaccgcggc 393841
gtcgatgtcg gcatcgtcga agacgataaa gggggcgttg ccaccgagtt cgaagctgat 393901
cctcttgatc tggtcggagc actgacgcat cagcaaccgg ccgacctcgg tcgagcctgt 393961
gaagctgatc ttccggacct tcggattggt gcagagttcg cggccgatcg cgtccccctc 394021
cgacgcatag accaggttca ggacgccgtc cggaaaaccg gccagttttg ccaatgcaaa 394081
catcgcgcct gcgaccagag gcgtctgctc ggcgggcttg agcacgacgg tacagcctgc 394141
cgcaagcgcc ggcgaaatct tgcgcgccac catcgaggcg ggaaagttcc agggtgtgat 394201
ggcgccgacg acgccgatcg gctgtttgat caccagcatg cgccggtcgg tcgatggcgc 394261
cgagatggtt tcgccataga tgcggttcgc ctcttccgca taccattgaa gataggctgc 394321
cgcatgctgc acttcggatt tcgcctcgcc aagcggcttg cccatttcgg cggtcaggat 394381
ggctgcgagg tcatcgctgt gttcaagaat gaaccggtgc catttccaga ggatatccga 394441
tcgcgcccgc gcggtcagtc ccgaccacgg ttcctgtgcg gcatcagccc tttcgatggc 394501
cgcgtgggca tcggcagcac ccatatccgg cacttcggcc agcaattcgc cggtggatgg 394561
gttaaacacg gagaaccgtt gccgctggcc agcgaccgaa gggtgcggtt cattggcaag

gttgcgaaaa agctcgggac atttcaggtg ccgcgtcaat gccgatgtca gtgtcattct 394681
tcgttcctcc cacgcgcgtt cgattgcgcc tcttcccgcc tgtcgcgaaa ggcaaagccg 394741
gagcaatgat cgccattgcg ccggctcgtc ccttggactg ctctctccgt taagtcagag 394801
agatgacggc ttcaatctcg accttggcac cttttggcag cgccttgact tcatagcagg 394861
cgcgcgccgg gtagggggtg gagaagaagc ccgtgtaaac gcgattgatg tccgcgaagt 394921
cgccaaggtc ggtgagcagc actgtcgtct tgaccgtctt cgacagatcc gtgccggcgg 394981
ccctggcgat cgcctgaagg ttcttgaggc attgttcggc ctgttcgaca gcattggccg 395041
aattgaactc cccggtggcc ggatcgattg gcaactgccc ggagacgaaa agcagatcgc 395101
caaccttgat ggcctgggag taggggccga ccgcgccggg ggcatcgttt gtagaaatgg 395161
gttcgatcaa agttttagtc ctccattggt atccagtgag tgctcaagcg tagcggctga 395221
cggcgaggtc ggtggcgtcg atctcgggct tccggccaga taccaggtcc gcaatgacgc 395281
gggcagagcc ggagctcatc gtccagccaa gcgtgccgtg cccggtgtta aggaagagac 395341
cggcgatctt cgttgggccg atgacgggcg tgccgtccgg cgtcattggg cgcagacccg 395401
accaatagga tgcttctttt gcatcgccgc cgggaaagag gtccatgacg gaatgctcga 395461
gtgtgcgtcg ccgggcgggg ccgagatcat tggtgtatcc ggaaatttct gccatgccgc

Figure 3 (Cont.)

395521
cgacgcggat gcggtcgcca aggcgcgtga tggcgatctt gtacgtctcg tccatgatgg 395581
tcgattccgg cgcccgcgag gcatcggtga tcgggatcgt cagcgaatag cctttgaccg 395641
ggtagaccgg cagcttgatg ccgtgacgct tcagcagtag cggcgaatag ctgccgagtg 395701
cgacgacaac agcatcggcc gcgagccttt cccagttggt tacgacaccc ctgaccttgt 395761
cgccctcgac atccagtttc ctgacttccg tgccccagga gaagcggacg cccaattgct 395821
ccgccttctt cgcaagcgcg ttggtgaact tgaagcagtc gccggtctcg tccttcggcg 395881
tcagcagccc accgacgatc ttgtcgcgcg cgggtcagca acgcgaagct cgccgtggaa 395941
gttgggcttt cgccgtcagc ctgcctgagg cgtatcaagc ttatggagca ggcaggtgtc 396001
atcaggggct atacggcgct tgtcgatccg acgcagtcgg aatcgaccat agccgtcatc 396061
atcaacatta cgctggagcg gcagacggag gagtacctcg acaagtttga agcggccgtg 396121
cgcaagcacc ccgaaattag ggagtgctat ctaatgaccg gcggatcaga ctacatgctg 396181
agggtggacg tcgagaatgc cggggcattc gagcgcatac acaaagaggt cctgtcgacg 396241
ttgcctgggg tgctgcgtat ccattcgagc ttctcgatta gaaatgtgtt agcgggccgt 396301
ctgaaagcaa aaagatgaaa cttgcccatt tgagagattg cgcggcagtg aggtaggctg

Figure 3 (Cont.)

396361
tgtacctcat atgaccgctg cccctcaaga tccgcagggg ctacaggcca cagaagatgt 396421
gagctcagca atcgaaggca ctaggtcgtg gtgacgattt aacggattga gattcccaag 396481
aaggggcaaa tcagattcaa cactgacttt tggaggtcag tgatggattg cgatgggctt 396541
cgggacgatc aatgggaacg tatcagaggt tttgtgcccg gggcacgaa gggcaagcgt 396601
ggcccgcgca cgaacaaccg gctgtttctg gatgcgctgc tgtggatggc ccgttcgggc 396661
ggccgctggc gagacctgcc agaacgactg ggtgactacc gcgccgtaaa acgacgctat 396721
taccgctgga tcgagatggg cgtgctcgac gagatgcttg ccgtgcttgc ccgcgaagct 396781
gatttggaat ggttgatgat cgattcgact atcgtgcgcg cccatcagca tgcggccggg 396841
gcgcgcaggg ctaaaggggg gcggatgccc agggcttggg tcggtctcga ggcgggctga 396901
gcaccaaaat ccatgctgcc ggcgatgcgc tcggcctgcc gcttcgcctc atcggcacgg 396961
cgggacagcg caacgacatc acagccgccc atgatctcgt cgacggtctc cacgccgatg 397021
ccctgctggc cgacaagggc tacgatgccg gacatctcat tgagaaactg gagaaaacag 397081
gaactgaaat cgtcatcccg cccaaacggg atcgcaaaat gcaaagggcc tacgacgccg 397141
cactctataa agaacgcaac cgcatcgagc gcttcttcaa caagctcaaa cagttccgcc

gcgtcgcgac acgctatgac aagttgctcg ccaacttcat gggctttgtc aaactcgccg 397261
ctatcgccat atggctcaaa tagttaaatc gtcactacga cctagcgggc ctatgcgcta 397321
tcttcccgtc gcgtcacgac gggaagaatg gcttgaaacg cgattcttaa ttgacggctg 397381
catggctgct tgccaattcg ccagccgggt cgacaacagc ggacggcccc ctccgcggcg 397441
gttgacccgg aaggttgtcg cgaggcggca tcgagacgat cgccgcgccc acatcaatgg 397501
cgtcgatctc ccgacgcctt ctttatttct ttgccgccga gcaatagctt gagcctcgct 397561
ttcgcgtcgg tgtgtgccaa gcgttggaag ctttggcccg aggggtttca acgtccgctt 397621
tgtcccagcc ggtggagaat ccatgccatg cgaaacgcgg cttcttctgc tactcctggt 397681
ccatgtgaca cacccatatg gccgccgatc atccgagtgc ggaagattag gtccggatca 397741
cgatcaacgg cctttgatcg gcgctgcgca acatagcgag cgggctgata gtagagcacc 397801
tgactgtcgt ggagggccgc gtcgatgtat gtcggcggat accgtcgatc aggcgtcaga 397861
ttatagtaag ggtcatagct tcgtagatat tgatagtcgt tagcaagatg cggatctcca 397921
tactctgcag tttctcttag ggcgtatggg agcgtgaagt ccaactccgt gtcgatgata 397981
tcggcaagtg gaacctcggc gagcacagct cgaaaaaggt cagggcgcag gacagcggcg 398041
gccagaaccg taccgccgcc agcgctcctg ccctcgatga caatgccgtc acggctggcg

Figure 3 (Cont.)

398101
aaccgatgct cgacgaggca ctcggccgca gcgatcaagt ccgtgtgcgt cagtcgcttt 398161
tgatcgcggg tcgccgcttc gtgccacgcc cgaccgagtt cgccgcctcc tcgcacgtgc 398221
acgatgccaa aggctacccc gcgatcgagt aggctcaagc gagcggtcat tgatgaaggc 398281
cagccaaaga aagccggtaa gctttgtgct ccgtagcagc catacacgtt cagcaaaacc 398341
ggaccgtctt cacctctatc tcgccgcgct actatcgaga ttggaacctc cactccgtcc 398401
tctgccttcg ccattacgac cctagcctcg tacagttctg gttcgaaacc tgataccagg 398461
gttcggtaga ggactttgga cttatccgtt aggaggtcgt gttggatgaa tatgtcaggc 398521
gtcacaaaag aacagatttt gtaggtcagc gcagagaccc ggtaaggatg tcgtgcgcag 398581
gagtagctgc cgcctgccga tagaccaacg gtcacggtgc agctatgttc gacggggacg 398641
atactgggcc cgactcgtcc atttcggtgg tgcgcgacta agcgaggttg aatcccttcg 398701
cgctctaaca caatcacatg ctcttcaagg acatgaatct cctcgagcgt tatgccggcc 398761
cgatgtggaa ccacttcctg ccagcgcgac ggtgaggtgt catcaatcgc cgtgcgcacg 398821
aggcgcaaat tcgggccagt gtcgttaact cgaaaaagaa actcgttgcc ccagtgttcc 398881
gcgtagatct cgtgccccag ttcacgtgca aggatccggc gccacatgtc tgtcggtcgt

Figure 3 (Cont.)

398941
tcggcaggaa gacaccatac ctccgcggcg gcgcgctgga tgcgagaaga catgtccgag 399001
gtgatgatca cgtctatgaa caggtaagcg ccgctgcccg accgccgaac caccagggcc 399061
agtcgctcat tcacttcttc gaacaccacc tcggaacgtc cggtctcgac gtccaatcga 399121
acaacacggt cgtgttggcg ccgatcggcg cgctcgcgcg taaagaagag cgtgcgattg 399181
tccgctgccc aaactagtcg cccagcgcgg gaggggtcgc gccagatctc gcggccgttg 399241
gtcatgtccc tcactctcaa ttcgtagcgc tcgttaccga tgaggtcgaa gctgaatgct 399301
atgtagcgac cgtcatcgct cggttcgagc gcgccgagag aatagaacac ttctgcccca 399361
gggagcgtgt tcggatcgaa gacaagctct tctggacctc cagttaccgg ccggcgccac 399421
catgctgaat gtagcaagcc gctttgactt ttctggaaat agaaaaaaaa gccgacttgg 399481
aacggtggtg gtgcgccatc gcaagaatct cgcttctcga tttcggcgat tagatcggct 399541
ttgagttctg ctacatagga cgtcacttca tccgcgtaat ggttctcggc ttctaaatat 399601
gcgaggacat caggatcttc cctgtcgcgc agccagccgt aggagtcgat cgtgacgtcg 399661
ttatgaagca ctcgaatccg gcgttcgctt cggggaagcg ggggctgcag ggacttattt 399721
tccatcagaa tgctcctgga attggattgc agacatagcg ttttgcaggg ctgagccaaa

gccgacggtt gccgagcaac aacgggaaga actctgaggc gtcggaaggc gatgggtcca 399841
ggaagttgag ccaacgctcc gtgttcgcga accggtcaat tcccctgtgt ggcaagccga 399901
ccccgcggag gcgcacctca agctccccac caatggttgc agaacagctt gcgacaggca 399961
cggctcactt ctccgggttt atacgtcagt cccagctaga aaggcttctg cggccaagac 400021
gaagtaagaa gcttaagccc agggccacac aataattcgg aaacgaaggc gcttttgggc 400081
gcaatgtagg tgagcacgac ggaatcctgc aaagtttcgc ccgctcgcgc tttaatgcgg 400141
cgaggcgcgg ctgtctcaac gccagatgcg gaatatcatc ctccgattgg actgcgtgag 400201
caaaatttcc gcgtcgtggg actggaaaag tccatggacg tgcaggattg ctgcgagatg 400261
agcctttaaa cacccgaagc ctgcaattct tgcgagtctt tgcaggatca ctgcagagcc 400321
gcgccgatac aatcgggcga tggaccacga ttcatctcaa aacaggggag caccaaatgg 400381
tcgacgtgta cagcgaagtc atcaaattct ttggcgtacg tccgaaaggc gctgcactag 400441
cgagtgccgc cgtgtgccta ctcgtctggg ctagtgcggc agaagcggtg accctcgagg 400501
aagttaaggc acgagggtac attcgaattg cgatcgccaa cgagattcca gccagctaca 400561
cagatgctaa cggcgacgtt aaggggcgag aagcggaagt ggtccaacat gtccttgaac 400621
gcatgtgcgc gcttcgcaaa aactggacat tgattccgct aaatcccgga cagcaatttc

Figure 3 (Cont.)

400681
attaaagtcc ggacagtttg atgcggttgg tcctcggcag cctggttagc atcagggctg 400741
attgatttcg ccgttttctg ccccagtcaa gaggggtgcg ctttttttgct ttcgcatgct 400801
ctcgccccgg agggtgatgc ggtgagcatt gtggacgata cggtcgagta tggcgtcggc 400861
gaccgtgctg tcggcaataa ggtcgtgcca gcttgccacg ggaacctgag ctgtgatcag 400921
ggtggacttt cgctgataac gctcctcgac gatttcgaag aggtgaaagc gctgctgatc 400981
ggagagcgta tgggttccaa agtcatcgag gatgaggagc tggacgcggg tgagcctgtc 401041
gatgaggcgg gggaaggagc cgtcgaggcg ggcaagcgcg agctcctcga acattcgggg 401101
cacgcgcaca tagagcacgg agtgaccgag cctggccgct tgcctgccga aggcacaggc 401161
cagccatgac ttgccggtgc cggtgtggcc ggtgatgatc aggccctcgt gggcggtgag 401221
ccattgcccc tgggcgagcg ccatggtgtt gcgccggtcg agaccgcggg cggcggcgaa 401281
gtcgatatct tcgatacagg cctgggcaaa gcgtagcttg gcggaggcga gccggttacg 401341
gatgcgcttg tcggcgcgca gggtgacttc gcggtcgagc atcagtccga gccactcatc 401401
gcggctgagc tcattggtgc cggactgctc ggtcaattcg cgccaggcgg cggccatgcc 401461
cgtcagcccg agggcctgca tctggtcgag ggtggggttc gtcagcattc ttgcttcctt

Figure 3 (Cont.)

401521
cactggtagt aggatcggcc acggatattg gtatgcgcag gcgtgggggc cgcgtgttca 401581
gcctgcggtc tttcccggtc gaggccggat ttgaggatgg aggcgacgga ggaataggtg 401641
atggcattaa tggtgagcgc ccgctcacag gccgcctcga ggcgctggga tccatagcgc 401701
ggcgccagcg acagaatgcc catggccgag cggtatccct gttccggatg cggcctgtcg 401761
cgcatcatgc gttcgaccag gatggcggca ttggggccga tctgggtcgc acggccgatc 401821
agattggccg gcgtggtgtt ggcatagcgc tgatgcgcct tgggcatatg gtcgttgacg 401881
gtgacgtggc cggaacgctg ggagcggcga acatggctgg cgacacgctg gtggtcgtgg 401941
aagatctcga ccacccggtg ggtgagccgc acctggaggg tgcatccgat cagccgatgc 402001
ggcaccgagt agaaggtctt gtcgacctcg acatgatagt ccggatggac cttcgccgac 402061
ttccattccg catattcgaa cggtatcgcc ggcaagggct tcaaggctgg ccgctcgatc 402121
tcctcgaaca gctcgcggcg gcttttgccg acatggcgca tcgtccggtt gttcaggtcc 402181
tcgagcaatt cggcaatcgc cgtgttgagg gcggcaagcg agaagaaggt acggttcctg 402241
agccgggcca gaatccagcg ttccacgatc aataccgcgc cttcgacccg gcctttgtcg 402301
cgcggtttcc tgctgcgggt cggcaggatc gtggtgtcgt aatgctccgc catggcggcg

aacgtcgcag tcaatgtcgg ctcgaaccaa agggccttgg ccaccccga tttgaggttg 402421
tcgcacacga ttgccttggt gaccccacca tagaaggtca gagcacgcac ctgaccgtcg 402481
atccaatccg gcaactgctg gctaaagctg gcatgggcga aggtcaggtt ggaggcgccc 402541
agcaccgcga caaagatttg ggccggatgg atgacaccgg ttgccggatc gatcaccggc 402601
accgtcggcc cggcatagtc ggtctgcatc acggcgcccg ccgcgtgccg attgcggaac 402661
gctacactgg tgcgctgccg aaaggcggca acctgctcgc agaaccaggt gaagccgtaa 402721
ccatcaggat ggctggcgcg gtattcctgc catagaagcg tcagcgtcac gcctttgcgc 402781
ttcagctccc gaaccaccag cgcccagtcc ggctcgctga gatcgcgcgg cggtcgaccg 402841
gctcggccga acagccgccg ctccagcttt gcatcctcgt ccgcgccgat tggcaacggc 402901
cacgaaagcc cggcttcccg agatcgcagc aaataggtcg ataccgagct cttgccgatc 402961
ttcagccgct cggcaatctc gcgcaccgaa agaccctctt catgggtcag gcgcagaata 403021
gtccggatat ccctcactgt cgttcgtctt gcttgcttcc gtctcggcat cggcccctct 403081
caacgttgtc gtgagaggcc taaccaacaa gacggcgcag ccgcgaacca acccgtcaaa 403141
ccgccgccgg aaactgtccg ggatttagcg gaatcgctgt ccgggaatta ctgaaaactg 403201
tgtccggaga ttaccggaaa tcctgtccgg actttgccga aacccgcacg catggacatc

Figure 3 (Cont.)

403261
aagcgtgaaa acatccaatg gatcgttacg tcctttagct ctttgatacc aggcttacag 403321
gcaaatcgct tcgacatgac ggcagctgga atggctatcc gcccagaaag atgtcaaaag 403381
gtaatctata gcgagccaac cagttcctat ggcgagggtc tactggtccc aaaaggtaat 403441
cccaaaaatc ttcactctta cgaggacatt accacgcaag gtaaagttgc gatcatggcc 403501
ggtgctgacc agctcagaat gatgcagaag ctgggtgttg aagaaggaaa tattatcacc 403561
atcgcatcga atgcagatgc tattgcagct gtctctcagg gacgcgctga cgcctacgca 403621
gcatccgcca ctaccgccgc tgatttggca ggtaagagcg ataaagtcga actcgcagca 403681
ccctttaagg atccgattat tgacgggaag ccccaaagga gctggggcgg ctatacgttc 403741
aataaagaat ccggcgacct tcgcgacgcg atcaacaagt cgcttcttga gtttcaaaag 403801
actgagaaat tcaaagagat tcaattggcg tatggcatga caaaggaaag cattgccgcg 403861
atcccaacga aaaccaccga tgtcctttgt tcaccgtaaa gcggaagatt gatgggtcgc 403921
tcatccagcg acccattcct aagtccttct ttcgaatacg actcgcgaca gccttgtgac 403981
aaccattgtg accgggtgca ccagcgacac tgaatgggac aaaagtctac aaatgcattc 404041
agaggagcgt tgcggcctca gcagaccaac acgctgttcc tcgcgccaag ttcgggtttc

Figure 3 (Cont.)

```
404101
gaggtctttc aattaatgga acgcagtttc gagcgtacgg gcgtcgttcc tcggtgattg

404161
acagccggag aaagcgtcat tatgcaggat gtctgcaatt ctcaagaaat cctgcaggat

404221
tacgctatgg aacttgatcg ggcagatgtg gcgctcctca atgccgtaca gaaaaataac

404281
cggctcactt ccgaagaact cgccgacaag gttggccttt cacccacagc atgtcagagg

404341
agacttaaac ggctccgtag cctaggtgtg atcgaagcgg atgtgtccat agtgtctccc

404401
aaggctgtcg gccgccccgt aacgatgatt gttatggtgt cattggaacg agaacgtgcc

404461
gatattgtcg acaggttcaa gtcctctatt cgaaatacgc gggaggtaat gattggttac

404521
tacgtcacag gtgatgcgga cttcatccta atagtgacag caaaggacat ggaggaatac

404581
gaggagttta ctcggaggtt tttctatgag aatcacgaca tcaagggctt taagaccatg

404641
gtggttatgg atcgagtgaa agccacattt gcagttccaa tcgaaatcta gtccgaaact

404701
atcgtgttcg cccgacgcca tagccggcga actcgcacaa acgtaggctg gcgcgacctg

404761
ctagcgcaat gacctggagg ccggatgaag tgccgtcggt caatcatctg gggtagcgtg

404821
accggccctg gaaatagtag accccttctg tgtctctaac ataaaggcgc ctgtccacta

404881
ggacgcgatc ctcgtacgcc gcacgtgtca gttagaaacc agcagtacag gaggacgtcc

```

gccaatccct cgcactgtca gtcttcggac tagaagcaga gcgcattaca accccatgcg 405001
gggaagtccg ggtggttccc gtccaaaccc tgcgaaaccc gcctgaattt tactgatttc 405061
ctgcggccga ggcagaaaaa tgccgaatcc tggcggccga gtgcattgat catccccagc 405121
ggcggcttcg taagcccgct caaaaagggg aaccaaatga cacatctaaa gatctccaaa 405181
accgcacctg ctgttgctcg cttccttcct gccggccgca ttgcgagtgt ggctgcggcc 405241
ctaagtttgt tcttgtcagc gcagcttgca ggtgccgtga cgctcgagga agtgaaagcg 405301
cgcgggtaca tcactatcgc aatagcgaat gagatgcccg gcagctatac cgacccgaac 405361
ggcgaggtga agggctctga ggccgatgtt gcgcggcgcg tcctcgagaa attggggatc 405421
aaaccagaga acattcaatg ggtcgtcacg acttttgggt cgttaattcc cgggctgcaa 405481
gccaaccgct ttgacatgac cgccgccggg atggccattc gaccagagcg ttgcgagaag 405541
gttatctaca gtgagccgaa ttccagttat ggcgagggaa tgctggtgat caaaggcaac 405601
ccgcgaaact ttcactccta tgaagacgtg gctcaacagg ggaagattgc gatcatggcg 405661
ggcgccgatc agttgcgaat gatgcaggca ttgggcgtcc caaacgagaa cataataacg 405721
atcgcagcaa atgccgacgc tatttcagcg gtcgccaccg ggcgcgccga cgcctatgca 405781
gcggcggcct caactgcagc cgaccttgcc aaaaagagcg acaaagtcga actcgccacg

Figure 3 (Cont.)

405841
cctttccaag atccggtcat cgatggcaaa attcagcgca gttggggtgc cttcagcttc 405901
aacaaggaat ccgccgacct gcgtgacaag ttcaacgagg cgctcctgga gttccgcaag 405961
acggatgagt tcaagcagct cttgctcggg tacggttatt tgccagagtc gatcgcggcg 406021
atacccgaca agacgaccaa agagttatgc tcgaattgag gcagcaagaa cgattgaacg 406081
tcgaccgaaa catccgtcga cgtctctccg gtgcgaacgc gccgcgtcta ccttccactt 406141
aaaggcgagc tatcaatgga ttggcacgac tacctcggac cgttgggtcg tggcgcctgg 406201
gtcacgatcc aattcactct ttactctatg ttctttgggg ctgtctgctc tttcgcgttc 406261
gggattggaa agctttccaa gaacccgttc gtcaaaggct tttcaatcct ctacattgag 406321
atcttccgcg gaacatctct attggtccag ttgttctggc tctttttcgc cctgccgatc 406381
gccggggaca tgatgggcat cgatctgcga ctttctcccg tagtggctgg cgttctcgct 406441
cttagcctta acctgggggc ttatggtgcg gaaatcgttc gaggggcaat tcaggcggtc 406501
agtcctagtc aatatgaggc agcaacggcg ttgaacttca gctcgtcaca agctctctgg 406561
cgcgtggcgt taccgcaagc gatcccggag atgatgccga gtttctccaa tctcgcgatc 406621
gccgctttga aagatacctc actggtatcg ctcattacat tgcatgactt gactttcgcc

Figure 3 (Cont.)

406681
gcggagcaac tgcgcaattt ctaccaagat agcacgaccg tatatacaat ggtccttctt 406741
atgtatttcg ggatagcact cgtactgtct ttcttcatgc gcctcataga atcgtcggta 406801
acccgctggc gcggacatcg gaggtagaaa tgctctacgg ttttacatgg gataccggca 406861
acggagagtt agcattcgct atttccattt tgccaatgct tttgatggga ttgataacca 406921
ctctccaggc ggcctttctg ggcttcttcg tcgcatgcgt cctaggaatg gtgttcgcgg 406981
ttttacgggg gatgcgtacg agatgggtag cctggccggc cgctgtccta atcgagttca 407041
taagggacac gccattaatc gcccaattgt tcttcttgta ctatgtactt cctgagtatg 407101
gaataatatt ccctgccttt ttgaccggag ccttggccct tggcatccag tatagcgcgt 407161
atatttccga agtttatcgg ggcggaatac aggctgttga ccacgggcag cgggaagcgg 407221
ccaagtcgct tgatcttcct cctgcgcgca cgtttacgca cgtgatcctt ccgcaggcca 407281
ttcctcgtgt catacccgct ctcggaaatt atctcgtctc tattatgaag gacgttcccg 407341
ttctttcggt cgttacaatt gttgagatgc taaacgcggc taagatcatc ggagaccaga 407401
ctttcaatta tctcgtgccg ctttctatgg ttggtggcat ctaccttatc ctaacaatcg 407461
ttgcctcggc gctcgttcgg atcgtcgacg tcaaccttcc caaaagaggg gttcccctga

Figure 3 (Cont.)

407521
gatgagtgac tccatcatcg ttttcgacaa ggtaaaaaag gcctacggca atttcaccgt 407581
gatcaacgaa ctcgatttcg aggttcgacg tggggaaaaa gtatctatca ttggcccttc 407641
cggctccgga aagtcgactg tccttcgcat actgatgacg ctcgaaggca tcaacgatgg 407701
agcagtctac gtgggcgggg agcctctttg gcatgagcta aagaacggtt ctatgatgcc 407761
tgcgacagaa aaacatctca ggaagatgcg cacccaactg ggcatggtct ttcagcagtt 407821
caatctcttt ccacacatga cggtgctcag aaatctcacg gaggctccgc gggttgtact 407881
cggcctatcg aaagaggaag cgcgccgacg tgccgaggaa cttcttgagt tggtcggcct 407941
agttgatcac gcacataaat ttccagctca gctttcgggg ggccaacagc agcgtgtggg 408001
gattgccaga gctttggcga tgcgaccgaa gattatgctg ttcgatgagc cgacttccgc 408061
tctagatcct gaactggtcg gcgaagtcct taacgtcatc cggaggctcg cggccgagca 408121
cgacctgacg atgctgatgg ttacacacga gatgagattc gcgcgcgaaa tatccgatcg 408181
tgtctgcttc ttcgacaaag gacgaatccg tgaagagggc acgccagagc aattgtttag 408241
tcagcctaag gaagagcgta cgcgcgaatt tctcaaggcg gttcttgacg ggtgatgatt 408301
ggcggccggc cagtgggccc atggccagca gcgtgactgc ttcaatttga gatccgaact

catcccgagc cggtgcattc ctatctcggg tgccttcttg ccgtcgcgat gatcatcgcg 408421
tttgcgtgga caagcggctc cgttttggca gtactcgatc gggctggctg gtctcggcgc 408481
cacaggatcg acggcgacgt aggcgcctca gactcgttgt acgggtggga cggtcgagcc 408541
gtttgtgagg caacgaaatg agcttaatcg ccaatccacc gtacctaaaa gattcgcatt 408601
ccgcttgcgt cctgcgcaaa cgaatggaag ggccggaatc tgcgtgaaac gctcaccgaa 408661
cgccggaatc ctgcagcatc agcacctaaa tcggcaaacc tgctcgtctg ttgatgataa 408721
tctagtttca aacagcttta ttggatgagg gcagcaatga acttccgtat caataacagt 408781
cttctaatcg aagccgagcg cgacgcggtt cttgaattgc gtcacgcgat gcatcgggag 408841
ccggaacttt ccaacaacga gtggaaaacg cagcagcgaa taagagggat gcttgagcgg 408901
ttcggcctga aaggggcgac tgttttccat aatacagggc tctacatcga catcgaaggg 408961
tctgcttccg gaccaaagag agcggttgct gtccgcggcg acatcgatgc ccttcccata 409021
caagaaactc gcgatgattt gccgtaccag tctcacgtgg agggagtgat gcatgcttgc 409081
ggccacgacc tccacgcttc catcgccatg gggtggcgt tggcctttca ccgaatgcga 409141
aacaatttcg ctggcaaact gcgcgtcttt tttcaaccgg cagaagaggc tgaaccgctt 409201
ggcggtcgca cggtgctcga agagcgactc cttgagggct tcgacaatgc tgtgggcttc

Figure 3 (Cont.)

409261
catgttaccc cgtcgataca ggtgggcaaa ttcggcgccc gcgaaggagc agtgagcaaa 409321
tcgtcggacc aattcaaggt taccgtgtct ggcagtgcag cccatggctc aacaccccat 409381
aatggcatcg acgcaattac gattgcggca gcttttgtca acgaagtgca gaaggtcatt 409441
tcaagggaag tgccggtcga tgatcgatcg gtcatcacga taggcacaat ccacggcgga 409501
gaggcgacta atattatttg tccgaaggtc gtgatggagg gaacaataag aacgacgaac 409561
ccagaactgc gaccgctatt gtcgcaacgg gtgagagaaa ttgccgaagg cgtcgcagca 409621
cttcatcgcg gaaaagccga ggtcgtcgtt acatcaggtg aaccggcggt catcaatgac 409681
cccgaaatgg tgcgcctctt ccgcgacgcc gtgtccgata tggcgggttc cgacgcgttg 409741
acgcagggca aggccattag cgggagcgat gacttcggtt tctactctca atgcattcca 409801
tcgatctatt tctggttcgg cagtggcgaa cccgggaacg agtccggtgt gcataccccc 409861
acgttcgcgg tttccgacga cgttctcatc ccgacgaccg aacttgctgt gaagtattgt 409921
ttcgatttgc tgcatgggca gtctgcacgt tgatcgactt gtatgccagg atgtttgcca 409981
ctgtattagg tgaatgaatt gtcgaactta agtctagaat cgatcgagcg agcgcgtgag 410041
cggatcgaag agcacgtctt ccgtacccct ctgacgacat caaggtcgct aaccgaactt

Figure 3 (Cont.)

410101
accggaactc aggtcagcct caagctcgag cactatcagc gcactggtag ctttaagctg 410161
cggggtgcga caaacgcaat tcttcaactc agcccgtcgg atcgggcacg tggggttatt 410221
gcggcatcta cgggcaatca cggacgggct ctttcctacg ccgcaaaagc ggtcggctct 410281
cgcgccacca tctgcatgtc ggatcttgtt ccagaaaaca aggtttccga gatccggaag 410341
cttggcgcga cagttcggat agtgggatcg tcacaagacg atgcgcaagt cgaagtcgag 410401
cggctcgtcg cggaggaagg cctcagcatg atcccgcctt tcgatcaccc gcatatcatc 410461
gccggccagc gaaccgtcgg tcttgagatc gttgaggcga tgccggacgt cgcgatggta 410521
ctgcttccac tgtcgggtgg cggcttggct gcaggcgttg cagcagcggt gaaggcactg 410581
cggcctcatg cgaggatcat cggtgtcact atggatcgag gcgccgcgat gaaggccagc 410641
atcgaagctg ggcatccggt acaagtgaag gagtatcgga gcttggctga ttctttaggt 410701
ggaggaatcg gcatggccaa cgcttggacc tttcaaatgt gcagagccct tctggacgat 410761
gttgtcctcg ttaatgaagg cgaaatagcc gcgggaatta gacatgctta tgagcatgag 410821
cgtcagatac tcgagggcgc cggcgctgtc ggtatcgcag cgcttctctc cggcaaggtg 410881
gctgctcgcg gaggttcagt aggagtcgtt ttgtcaggtc aaaacatcga catgggcctg

catcgggagg tcattaacgg agttgtcaga gcgaccgagg aggattgatg cctacaatga 411001
aaatactcac tgagggggag ttgaggcaaa tcgtgccgct cgacctcgac gcggttaagt 411061
gcaccgaaga cgctttccgc gcactcgccg taccaaacgc cgtaaaaatg ccgcccattc 411121
tgcgcttgga cgtgcctgac agcaggggtg aagtcgatgt gaaaactgcg tatattcccg 411181
gtttgggcgg ttttgcgatt aagatcagcc ccggcttctt cgacaaccca aagatcggcc 411241
ttccgagcac aaatgggatg atggtattgc tctcgagcca aacgggtttg gttcaagcgc 411301
ttcttttaga caatggttac ctcaccgacg ttcgtacggc ggccgctggc gccgttgctg 411361
caaaacattt gtcgcaacaa gatgcttcgg tcgcaaccat ctttggagcg ggcgttcagg 411421
cgagactgca actgcgtgcg ctgactctgg tgaggcctat ccgccaagcc cgtatatggg 411481
cgcgcgatca gcttaaggcg gaggcactcg tcgagcagtt gaagcttgag catagcttcg 411541
ccatcagcgc gtccgatgat ccacggcaag ccgtttccgg tgcccatatc gttgttacga 411601
cgacgcccgc agaccggcca atcctcgtag cgtcctggct tgaagctggg cagcatgtaa 411661
ctgcaatggg ctccgacgct gagcataaaa acgaacttga tccagcggca atcgcgcgcg 411721
cggatgttta tgtggcggat agtcttacac agacacggag actgggtgaa cttcaccatg 411781
ccatagaggc aggcctcatc gcgcgggacg ctgcttttcc ggagttgggg gaggtgattg

Figure 3 (Cont.)

411841
cgggcgtgaa aaccggacgt acccgcgagt cagatatcac tatagcagat cttacgggga 411901
ccggtgtcca ggacacggca attgccacgc ttgcctttca gcgcgccgaa gaacgcagtg 411961
ccggaagcct attcgagagc tgaacaactc gcgctcctga cgcctcagcc atgttgaggc 412021
gctgacttct catctgttca cacgttacct tagtatccgc cgtcctgcgg acaatcatgc 412081
aactaaatgc tcagaccata tcctacagga ggcagccatg ccggttatca agggacccca 412141
agtatttcct cgcgccgaat tccttaggcg actcaatgct gtgaagctgg agatgggccg 412201
gcttgaaatc gatgcgctca ttgtcggcag ttctgctgat atcacgtatc tgaccggcta 412261
tacggctaag tccggatatg tgccacaggc tctcgtaatc tcatcgaatg acgaagagcc 412321
cacattcatc ctgcggcgcc aagacgcgcc tgcggcgatc caccagacat tcatggatcg 412381
ggacaaagtt atcgggtact ctgaagccct catcgggaac cccgataagg acggctatga 412441
cgccgtagtt gacttcttga acgaacgcga tggtgccaac aagcgcggtg ttggagtgca 412501
gcttggctat ctgtccgtaa gatcagctga aaagtttaag acgcgcctgc caagcgcgcg 412561
aattgttgac tgcacccatt cggtcgcgtg gatccgcatg atcaaatccg atctcgaaat 412621
ttcgatgatg cgtgatgcgg ccgcaatcgc agacgcagga gtccaaaagg cattcgaagt

Figure 3 (Cont.)

412681
cattcgaccg ggagtgcgcg aagccgacgt tatggctgac gtcgcagctc aacttgcgcg 412741
ggggacaaac ggtaaagcgg gaacagatct cgcgtcgatg tatttctgtt cttcaccccg 412801
aaccggcaca tgccacattc gatggagtga agatgtcatc cgcgatggtt ctcagatcaa 412861
tcttgaaatc gcgggcgttc gtcacggcta tgtctcagca ataatgcgga ctttctccgt 412921
aggtgcccca tccgatcgac ttcgacgcat tcatgacgcg gaggtactgg gtttggaggc 412981
cgcgctcagt acggtaaagc ctggcgctac ttgtagcgac gtcgcaaacg cattctaccg 413041
cacgatcgaa aagtccggct ttcaaaagga ctcccgctgc ggatatgcga tcgggatcga 413101
ctggagcgaa ccaactgcaa gcctgaagga tggtgatatg accaaactca agccaaatat 413161
gaccttccac ctgatgctcg gcaattggat tgaagaagat tttggctacg tactcagtga 413221
gaccttccgt gtcaccgaag ccggctgcga agtgctgacg aagtcgccgc ggcaactgtg 413281
tgtgatctaa agaaggcagc caacgaaagt tggtttctaa caacgtgacc cacttcgata 413341
atcagacgca aattggctgg ttcggccgcg gagaagcgtc aattctcaaa ccgtcagcag 413401
ggagccttag cgtcgttgga cgcgagcgct ctcgaagcgt caaggaacca aaatgcgtat 413461
tcttcatttc tcggacgctg agtatcagca gcggatgctc cgagtaaaac agcggatgca

agctcaagac atcgatgtct tgattgtcac tgagccggcc aacatcaact atctcactgg 413581
atacgatgct tggtccttct atacggttca ggcactgttg gtgttccaag acgttgattt 413641
accgatgtgg attggcagat caatagataa gcaatccgca attgttacaa caaatcttcc 413701
tgatgaacgg attataccat atccggacat atatgttcat tccccagatc ggcacgccgc 413761
gcaatttatt gcgcaaatgc tgttaaggga ggctccgcgt gccaagactg tcggcgtgga 413821
aatgggcgct tattattata cagcgcgtga tcatgctgaa ctgcagaagg cattgccaaa 413881
tgtcgcgttc aaggacgcag agttgctcgt aaattgggtg cgcttcatca agagcgagcg 413941
ggaaatcgct tacatgcgag aagccggcgt gattactgaa cgcatgatga aacgggcggt 414001
agaagtcgca gcgccaggtg tacgacagtg tgacgtggcc gctgcaatct accatgcaca 414061
aatgtcgggc acagagaact atggcgggct tcctgccacc agcccaccac acatggggtt 414121
cggtgagcgc gctagggagc cgcacccgat atttaccgat cgacgtatcg acacaaattc 414181
tgttgccaat atcgaattgt cgggatgccg acttcgatat cacgcaccca tgagcaggac 414241
agtctatttc ggcaggccgc cccagagtta ccgggactta gcgtcctatg tgattgaggc 414301
cgtcgaaacg tcactcgatg ctgtccgacc tggtgtgacg tgcgaaggca tcgaattagc 414361
gtggcgcaag agcatgagcg ctcatggcat cgagaaggaa aaccggctgg gttactccat

Figure 3 (Cont.)

414421
tggcattgcc tacacaccga catggggcga gcgaacggcg agcataaggc ggacggatct 414481
tactgttctt gagcctgggg cggcatttca cctcatgggt ggattgtggt tggcaaacac 414541
cggaataacg atcacgcagt ctttcgttgt aacagcaacg ggtcacgaac cccttacggc 414601
tacgcctcgg gaactggtcg ttaaagactg acgccagatg ggcccgccga ggctatgagc 414661
acttcaacgc gacgtgtagt ccgatttcga ctttcgtttg cgtcgcagcc gtcgcctgta 414721
tgcgtttttt ttggactcaa ttctcaactg ctttggcaag cggcgccgtg tcacgtgtcc 414781
ttccatctga tctgcgcgtc caacaacgag ctcagaacta aatcgcggcc gcgacttctg 414841
caggacgaaa aaagggcggt ctggcggcgc ttgcgacagt tttgcccagt cgtttttcct 414901
cggattgcac aatcgatgaa cgcgctcgcc ctccggggcg caactagaga aggaagcgcc 414961
ttggcctttt tcggtcaact cgccaaatat ctgaacagga ttggaaagcg tgcggaaaaa 415021
tcgaagccct ccgattggga aaagtatgac gtaaaatatc cgaataagcc gcattcggtc 415081
agaagcgtca ccttaaatgc aggatttcgt cgcagcggaa atcattctgc cggaaatgtg 415141
caccctgcgt cgcctatgat caaagtgcaa ggtggctagc ggctcgagcg tgagggacgc 415201
gccagaccag cgtttcaacg cagtaacaac taaaaagtgg gaaccaaagc gatgacaatt

Figure 3 (Cont.)

415261
tctcggcgtg atctcttcaa ggcaggcttg gctgcaggag ctgctctctc agttccttcg 415321
cttcttcggg cgcagaccgc agttgcggcg gataaaactg ttcggatggc actggaaaat 415381
ctcagcgtct ttgatccggt ggccacgaca gccggcatca gccaaaccca tgctctggcg 415441
atctacgaca cactgttctc ggctgactcg cagtctcaac ctcatccgca aatggtgggg 415501
aactggggcg tttccgatga taagaagacg tacacattcg aattgcgcga cggtttagga 415561
tggcatgacg gtacccctgt caccgcagct gactgcgtgg cgtcaattcg ccgctgggcg 415621
caggttggat ccggcggaca gatccttatg tcgcgagcta gcgacatctc aaaaaaagat 415681
gacaggacat ttgtcatctc gctcaaggag cccctggggg ctttgccaag catcctggcc 415741
ttcgagggtc cgtttatcat gcgggagaaa gacgccggac tacctccgac ggagcaggtc 415801
actgcgaaca tcggatcagg accgtttaag ttcaatcacg acctagccaa acctggcgcg 415861
agtttcacgt acgaccgcaa cgaaaaatat gtgccgcgca aagagccgcc tgacggaatg 415921
gctggcggca agacggtcta tgtcgatcgg gtcgtgtggg atatcggcgt gctcgccgac 415981
ccgcagactt ccgtggccgc tcttcagacg ggcgaaatcg actttctcta caggccgccg 416041
attgatctgt tgcctctaat cgagagcgat cccaacctga aactcgaggc gctgaatagg

gctggtgtgg acatgactct gcgcatgaat tgccttcagg cgccgtttaa cagcgtaaag 416161
gctcgacagg cattgctcca cctcgtggac caagaggcag tattgcgcgc tgcgtacggc 416221
aatccccagt atttcaagcc cgtcacgtca atgttcggca acacggcagc ggttaccaac 416281
gacgaaaata cgggatggtt caaaccaggc ggcgatcccg aaaaagcaaa gcaacttttc 416341
aaagaggctg gctatgcggg cgaaaaaatt gtcattctgc aagcgaccga ttgggccgag 416401
caaagcaatg cttcacaggt cgtggcggcg aagcttcgtg aaatcggcgt caacgccgag 416461
ctcgcgccga gcgactgggg cggccttgtc tcccgccgct cgaagaaaaa ccccgccaac 416521
aacgccggct ggagcatctt tatcactgac cagtctgagg caacacgtgc caacgttttt 416581
accgacatta gccttgccat gaacggcgaa aaggcatggt atggttggcc aaagaatgat 416641
gaatatgagg cgctccgggc caaatggttg accctcgaaa cgctcgatga gcgcaaggcg 416701
cttgcgcgcg aaatgcagaa gctgtggtgg gactacgtcc ctgaggttcc gctcggtcaa 416761
aacattgtac ctagcgctta cagcaagacg cttaccggcc tcatccctgc aacactgccg 416821
cttatgtgga acatgcagaa ggcctgatac cgtgggtgtt tacattcttc gcagactggt 416881
ttcgaccatc gccgtaatgg cgatggtcgg gattttcatc ttcctgcttc tcaggctggc 416941
gccaggtgat ccggcggcgg tcatcgcagg accaaccgcc acggagcaga tggttgctaa

Figure 3 (Cont.)

417001
catccgcgag gagttaggtc ttaacgaacc gttgcctgtt cagttcgtcc attgggcttc 417061
tgatgttttg aggggaact tcggagcctc ggttttcacg gggtgcccg ttctccaact 417121
gctttcccag aggttggaac cgacgatctc cctgtctgtg ttgacaatga tcctttcggt 417181
caccgttgga gtctccttcg gtgtactggc ggcatggcga tctggcggtt tcgtcgaccg 417241
cgccctcgcg actttttcag ctatcggcta ttccgtcccg gtcttcgtca ttggctatat 417301
cctcatctac ttcttcgcca ttcaaactcg ttggcttccg gttcaaggat atacgtccat 417361
caatcaaggt gtggcgccct ggttcttaca tctgatactc ccaacggtca ctttgagcgt 417421
cccctacatc gccttcattg cgcggattac gcggggcagc atgctcgaag tgctgtcgga 417481
agactatatg cgaacagctg ccgccaaggg tgcctcgcca tttgccatgc tattccatca 417541
tgcactgaag aacgccggcg tacccattct tactgtgatc gggataagct tcgcttatat 417601
gatcggaggc gtcgttctga cagagaccgt gtttaatgtg cctggcatcg gccgcctcgt 417661
cgtcgatgca atcaaaaacc gtgattatcc catcatccag accgtgctgg tcctaatttc 417721
cggcctgtac gttctgatca acctactcgt cgatcttgcc tataccctga tcgatccgcg 417781
tatccggtac taaagatggc ccttaccact tcgcgcgctt cgggatcgcc tcgtattcaa

Figure 3 (Cont.)

417841
acccacaccg ttgtccgcat cgcaaagcgg catccgctgg tcctcctcgg gggagggatc 417901
ctgctgttgc ttatcttgct cgcgcttgct gcgcccettt acagcggtga tcccttggtg 417961
atggacccct tcaagcgtct ccagcagccc tccgcctcaa tgtggttcgg caccgacaac 418021
ctggggaggg atgtcttcgc ccgaacaatc tatggagcgc gcatatcact catcgtggga 418081
ttgctttcag cagtgtgcgc agcggtttgc ggtcttttga tcggtgtaat cgccggctac 418141
agccgcacct ttgataacat tatcatgcgg gttatggacg gactgatgtc catcccgacg 418201
ttcttgctcg ctatagcgct tctctctctc acgggccccg gaattgggat tctcatcgtt 418261
gcaattgcga ttccagaaac acccgctgtt acgagattag tgcgttccgt ggttctgagc 418321
gttcgttcgc gaccctatgt agaagcagcg ctgtgtggtg gggcacgcct gcctagggtg 418381
ctttggcggc atattttgcc gagcaccatt ccgcccttga tggttcaaag cgcgactgtg 418441
tgtgccagtg cgatcatgac cgaggctggt ttgagcttta tcggcgtggg cgtgccctcc 418501
gagatcccaa gttggggtaa tatgatcgcc aactcacgcc tctttctcgc gatcgctccc 418561
ttgacgatct ttgctcctgg actgtgtctc gccgtcactg ttctggcggt caacctgctc 418621
ggggatggcc tgcgcgacat gttcgacccc cgttcgaagc ggaggcgtta aaatgagaat

gcaatcaaat ccgaaagccg atctgcttct ggacgttcgc gacctggaga cgcactttta 418741
cggcgaagag agcgttactc gtgctctggg cggtgtcaac ttccatgtga aaagtggaga 418801
gatgctgggt attgtaggtg aatcgggatg cgggaagagt gtaactgctc tttcgattct 418861
tcgcttactc ccaaagcaaa cagctaaaac agtcgggggc gaggtcatct tcaaggggcg 418921
caacctttta gaactgtctg agcgccagat gcgtgaggtc cggggtaacc ggatcgccat 418981
gattttccag gacccgatga caagcttgag tcctgttcac actgttgggc gccagatcgc 419041
tgaagcagtc caaattcacg gccgcgtgtc tcgcgccgag gccctcgaaa aggcattgga 419101
gatgcttcga cttgttcgca ttgccgatcc cgagcgacgc ctcaacaact atccgcacga 419161
aatgtccggc ggaatgcgcc agcgcgccat gatcgccatg gcgctcgcat gctcgcctga 419221
acttttgatt gctgatgagc cgacgacggc gctcgatgta acgattcagg cgcaaattct 419281
gcggctgatc gtcgatctga aggaccgtat gggaacggcc gtgatgttca tcacgcacga 419341
tcttggtgtt gtcgctgaga cctgccaacg tgtcatcgtg atgtatgccg gccgcattgt 419401
ggagcaggcg agcgtcactg acctgttcgc tcgccccaca catccttaca cgcgagccct 419461
catgaattct gtgcccgatc ggcggcgcgg tcggcaatct cgccttcccg aaattccggg 419521
ggttgtaccg agcctccgcg agcctcttgt cggctgcagc tttgctgagc gctgcccctt

Figure 3 (Cont.)

419581
tgcaattggg gtatgtcgcg aaaagatgcc tgtcctaagc gagatacaac ctggacacgc 419641
tgccgcttgc tggcgttcga atgaagtggt gaacctatga gcgacgcgct gctgaaagtt 419701
gagagcctga ccaagcacta tcctatcgaa gcgggatggt tcaagacgaa cgttcctgta 419761
gttcgggcag ttgaggacgt gtcgttcact gtccaggcag gagaaacgct ctgcgttgtc 419821
ggtgaatcag gctgcgggaa atccacgctt gcgcggctcc tgatgcggct catagatccg 419881
acgagtgggc gagtgctggt ggaggggacc gacatcgcag gactaagaaa gaacgagctc 419941
agagcttggc gccggcggat gcagatggtg tttcaggacc cgtactcctc tctgaacccg 420001
cgtctcaccg cgggccagat tatcaccgaa ccggtcgaga acttcgaatg tctaagtaga 420061
agacagcgcc aggaacttgc tacggatcta ctccgcaagg taggaatgtc gccggagatg 420121
gcgtctcgat atccgtcgga aatgtcgggc ggtcagcgcc agcgcttggg gattgctcga 420181
gcgctggcac ttaaaccttc actcatcatc gctgacgaag ccgtttcagc gcttgacgtc 420241
tctgtgcagg ctcaaatcct aaatctgctc atggatctcc agcaagaaac agggatagcc 420301
ttgattttta tctcccatga ccttgcggtc gtggagcata tcggccaccg cgttgcggtc 420361
atgtacctgg ggcgcatcgt cgaactctcg ccccgcgacg ctctttttgc caagccagtt

Figure 3 (Cont.)

```
420421
caccCctaca cagaggcatt gattgcggcc gcgccagttc cagatcctgc tcgcgccagg

420481
ctagaggtcc ccttggaggg agaagtgccg agcccgtca atccaccgag cggatgcgcg

420541
tttcacccac ggtgtccgct cgcggttgat cggtgtcgcg ctgaagtgcc gccactcgtc

420601
cctatgcccg atggtcgtgc ggtggcttgc cacgtacggg ccccggctgc cgcggctcat

420661
atttcgccga gcgctctcgc gtctcttgca ctgccaaaaa ccgttcagcc cggcggaaca

420721
attctcgccc gtcgttgaat caaaaagcta gcccagaaca ccaaggaaga aatatggaga

420781
agtgctcaca cgagagcggt cgtcattcgg cggagaatga cggcaaatac gatatcactg

420841
gttcgacggc gacgaacgtc gtggacggtt tcacaatggt ggcagttggc gacgttatcg

420901
tgtcgcgagc cctggcgaac gggcaccatc cgggctttag tgagatcgtc gagctcctgc

420961
gagccgcaga cgtaactttc ggcaacatgg agacgctgat cttcgacatc agatcattca

421021
atggaacacc gcaggctgag tacggggggg cgtatcacgt cagccttccc gagattggac

421081
ctgatctgaa ggcgatgggg ttcaatatta tgggccgcgc aaacaaccat tccttggact

421141
ggggcgtcga aggcatgcgt gagacgagcc ggatcctcga tgagagcggc atcatccacg

421201
ccggtgtggg tgaaagtcgc gcacaagcca gcgctgcacg tcttttagaa acggcccgcg

```

gtcgcgtcgc tttgctctca tgcgccacct cattcacgcc gatgtcgcgt gcatgcgatc 421321
cagcgggcga ggcaccagcc aggcctggag tcaatgcgct ccgtctagag agaagcgtcg 421381
tcgtcgagcc cgacatgctt gagagcctaa gaaagatacg tgatgccttg cccaatcctg 421441
ggcctaaaca cgatgatcgc gaaatgttgg tgctcgcagg aacgacctat agaaccggca 421501
aagacgtcgg ctacacctat gcggctaata cgcgagatct ggccgatatt ttaagaaacg 421561
ttcggcgcgg caagcaatat tccgatttct gcatttttac aaaccacgca cacgagccgg 421621
gaaattggag cgaagagccg gccgattttg agcaggcgct tgctcgcaag ctaatcgatg 421681
cgggagcgga cgcgtacgtt ggacacggac cgcaccgact gcgtggcatc gaaatctaca 421741
aacgccggcc catcttctat agtctgggga acttctttta tgatgacctc cggacacccg 421801
ttggggcgga catgtacgat gtgtacgaca aggacccaca ggtggacacc gatgccgaag 421861
taaccgcagc ggaagaaaca atgggttacc ctacggctgc agggttcata ggcgcgctcg 421921
ccgaaccggt gtattacgag agcgtcgtcg cagttagccg ctttgaggag aaccaactgg 421981
ccgaactgcg gctttatcca atcgagctcg gttattccaa aaggcttgcg aacaggggcg 422041
tccctagtct tgctccacgc cctcaggcaa tctcgattct tgaacgcctg cagaggttgt 422101
cagagccgtt tggaacgaga atcaccatcg aggaccgtgt cggtcttatt cgcctctaat

Figure 3 (Cont.)

422161
cgcatagacg gtcgacgcgc cataaggttc cattaacatg gctcagtagc ttcattgagc 422221
ctgcaaacgg cggcttggcg gccgtttgcg agcgcgccag ctgaatacgc gcgccccgtg 422281
ttcagatgat cgaaggtcaa ggattgcagc attgcaagat gttctcggct gcgatggggc 422341
aaacttggtt tccaggtccg tgacttcgca taatgggaac ctcaatagag gtaagttcct 422401
catctgtcgt acgccctcga ctcgccacat ccgtcgcggc ctccgtcgcg cggatcctga 422461
tccggcgtag agggcgctca gtttgcagca ttcctgcgcg caagtgatcg aatacgcagt 422521
caattccatt tcatggtcac gtacatttta ggtcgaaaca agcgcgttcg agcgcctgac 422581
aacaggaact catcgccaaa tccttcgcag cccgagagga agcatttatg accatcgata 422641
ttaaggacat cagcgagaag gaccgcaata cggtcctgca tccgttcaca cagctgaagg 422701
actttgcgac cggaaagctt cgtgagccga cgatcgtcga gacgggcaag gggatccgca 422761
tccaggacgc gcgtggtaac cagctgatcg acggctttgc cggcctctat tgcgtcaatg 422821
tcggctacgg ccgcaccgaa gtcgcggagg cgatctcacg ccaggcctat cgccttgcct 422881
attatcattc atatgcggca cacacgacgg atgaactcgc aattctgtcg gatcgcctcg 422941
tgaagatggc cccgggcaag atgagcaagg tgttttacgg catgtccggt tcggacgcca

Figure 3 (Cont.)

423001
atgagaccca ggccaagctc gtctggtact acaacaatct gcgtggcaag ccgacgaaga 423061
agaagattat ctcgcgcgaa cgcggctatc atggctgcag cgtcgtctcc ggctcgatga 423121
ccggcatgag cttctatcac gatcacatgg acctgccgct gccgcagatc tgccacaccg 423181
gcgtgccgca ccattattgg ggtgcaaacc cgggcgagac ggaacgcgag ttctccgccc 423241
gtcgcgccgc cgagctcgac gagatgatcg aaacactggg tcccgataat gtcggcgcct 423301
ttatcgccga gcctgtgctt ggtaccggcg gtatcacgcc gccgccggaa ggctattggg 423361
aagcgatcca ggccgtgttg aagaagcacg acgtgctgct gatcgccgac gaagtcatca 423421
ccggcttcgg ccgcaccggc tccatgtttg gctcgcagca ttacggcatc gagcctgacc 423481
tgatcaccgt cgccaagggt ctgacctcgg cctacttccc gctctcagcc tcaatcgtcg 423541
gcgagaaggt ctacaaggtg ctggaagacg gcgccgatcg cgtcggcgcc ttctcccatg 423601
gctataccta ttccggtcat cccattgggg cggccgcagc aaatgcggtg ctcgacatcg 423661
tcgaaaagga agatttgccg ggcaatgccc gtgaggtcgg cggctatttc caggcgcagc 423721
tcaaggagaa gttcgcccag ctgccgatcg tcggcgaagt gcgcggtgtc ggcctgatgg 423781
gcgccatcga gttcgttggc gatcgtgaga acaagaagcg tttcgaccca ttgctgaagg

tcggagctcg tgtctccaaa gctgcccgcg atcgcggcct tattgcccgc gccatgccgc 423901
atggcgacat tctcggcttt gcgccgccgc tcgtcaccac caaagaggaa gtcgatgaga 423961
tcgtcgccat ggccgagaag gccgttcgct ctgtcatgga tgagttggtc cgcgacggtc 424021
agaagctctg agcgatagtt aagccttcgg cggcggtgga tgccggccgc cgaaggcttg 424081
tgatcaacga ctgcatgaag ccggaaaggg gcaggagatc acctttgcct cgcagaccaa 424141
cgcgacctcc ggacgagagg tcatcaggaa tagggaacct ggctatgact cccgccaaac 424201
tccacatgac gaccagcctg gcgccgatcg ctgttcacag cccctatgat gggtcgctgc 424261
ttgggtcagt tgaggcgacc gatcctgccg acatcgatcg cctcctggca accgcccgcc 424321
ggggcgccga gatctcgcgc aatctgccgc ggcacaaacg agcgagcatc ctcgaaggcg 424381
cagcccagat ggtcgaaagc cgtcacgacg cttttgccga gatcatcgtt cgcgaagccg 424441
gcaagaccat cgttcaggcg cggaaagagg tgctgcgctg cgtcaacacg ctgaagctgt 424501
cggcggaaga agcaaagcgc aatgccggcg agatcgttcc cttcgatgcc tataccggct 424561
cggagcagcg ccagggctgg ttcacccgcg acccgctcgg tatcatcact gccatcacgc 424621
cttacaacga cccgctgaac cttgtcgcgc acaagctcgg cccggcgatt gccggcggca 424681
atgcagtgat gctgaagcca tccaacctga cgccattctc ggcgatcaag ctggtgggcg

Figure 3 (Cont.)

424741
cgctgcggga ggcgggcctg cctgaggagg tcatcaccat ctcccatggc gaccgggaac 424801
tggtgacagc gatgatcgct gctcgtgagg tgcgcatggt gtcctttacc ggcggctttg 424861
ccacgggcga ggcgatcagc cgcgcggctg gcctgaagaa gcttgccatg gagctcggcg 424921
gcaatgcgcc tgtgatcgtg atgaatgact gcgacttcga caaggcagtc gaaggttgtg 424981
tctccggcgc cttctgggcg gccgggcaga actgcatcgg cgcgcagcgc atcttgatcc 425041
agtctgagct ttatggccgc ttccgcgatg cttttgtcgc ggcgacaaag aagctcaagg 425101
cgggagatcc ccttcaggag gacaccgacg tcggtccgat gatctccaag caggtggcgg 425161
aacgcaccga agccgccgtc aacgaagcga tcaaggcagg cgcgacgctg ctttgcggca 425221
actatcgcga aggctccctt tatcatccga ctgttctcga aggcacgccg ctgacctgcc 425281
ggctgtggca cgaggaagtg tttgcgccgg tggtcatgct tgcacccttc gacacgctcg 425341
ataaagggat cgagatggcc aacgatccgg actacagcct gcatgccggt atcttcacca 425401
acgatctcaa cgtcgcactg gaggcagcaa acaggatcga ggtgggcggg gtgatgatca 425461
acgactcctc cgactatcgt ttcgatgcca tgccattcgg cggcttcaaa tacggcagca 425521
tgggccgtga aggtgtgcgc ttcgcctatg aagatatgac tcagccaaag gtcgtctgca

Figure 3 (Cont.)

425581
tcaatcgagg gtgagccgta agttccaagc ggttgactga atgcgcaagc gtacaggcgc 425641
ggggcaaatg ctcctcacca ccggcgtaac ttgaggggag attatggata agacccacgg 425701
caagatctgc gtcgccgagg tcgaggagat cgcggcggtc ggcagcctcg atcctgacca 425761
gatccacctg cctggtattt aagtgcatgg ccgatcaggg gccagcacga aaaacgcgtc 425821
gaacaacgca cgacgcgcgc ggcggcttga gggtaggggg aagaaatggc ctgggggtgc 425881
gcgtgctcaa cacgctgctg ttcgcgacga ggcgccgatc ggccaggaag cgtcttgcaa 425941
cgttctgcat cgacggcggc agggcatttg ccatgtgcgt ggaatcgtgt gaaggaaggt 426001
gtaagtgtca tgaccggcgc cgagtttcgt ctctgcgatg tcgcgctcga ctgctcgttc 426061
aaaacccgcg accagcgagt tgagcgcgaa caggcactcg cggtcctcga cctcctcgag 426121
gcgagtacct tcgtgcccgt cggccatcac ggcggcccgt atcgcctcaa gatctcgatg 426181
gccgccggcc ggctggtatt tcatatcgcc gacgataagg gagcgcatat cgtcagccac 426241
catctttcgc tcgccccttt ccgtcggctg cttaatgact acagccgcac ttgcgaaggc 426301
tactacgagg ccatgtgccg ctccaacctc gagcggctgc aggcgatcga tatgggccga 426361
cggggcattc acgatgaggc tgccgagcta ctgagggagc gtctctctgc taaggtcgac

atcgacaaag acacagcgcg tcggctgttc acgctcattt acgcgctgct cgctcgcaac 426481
tccggccatc agatcctttt gaattgaata gcctgcgatc aacgcccaca agcggggggg 426541
actccccacc gtttaacaag cggatttttg agcggccaga gaggggtcga aggtggtgcc 426601
agttttgagc atggcgcagg cgacggcgag gaggcggtcg gcgactgatc gcagggcgcg 426661
accgtggctg tgacctcggc ttcgaagggc ggcgtatttc aaacggttgt gaggtcgtgc 426721
tgaacggcga cgcgcgccca atggtacatg gcgttggcca gtcggtcatg gcaggcctgt 426781
cttctgacga cgatgcagct cttgcccgag cgcttggtga ccggcgcgac tcctgtcaag 426841
ctgcgcaagg cggcgtcgtc acgtcgctgc agggcatcga acgcttctgc gagcagcgtg 426901
gcgaggacaa cccttcccac tcccggcaag gatgcgagga tctccacgtc atgctgcttc 426961
ttctgccccg gctccacctg cgcggttgcg atgaggctgg cggtcaggcc atccagccga 427021
tgatgcgcct gtttgagctg ccggttgacg aggcggatgc gggcaatgag cgtagtgacg 427081
tgggcgctgg cggattcggt cgttccggcg gcgaccttga gcggcggctg gcgcaatata 427141
tcgagcacat gggggggcgt cgaagcggcg gatgcgatgg cgcttgagaa gcttggcgat 427201
cgtcgcctcg cggatgcgcg cggctttgtc cggcgtcggc acggtgtccc agagatcgag 427261
caaccactct gccccgaggt cgttttcgag ctcaagcagt gcggggaagt agcgccagag

Figure 3 (Cont.)

427321
ctgctcgcgc atacggttcg tcaaacggtt gcgctcggcg ctgaggtctt cggcgatgcg 427381
cgaccactcg cgcaattcga tgacgacggg gtcggagacc gcgagcagcc gaaagcaacg 427441
cggatcggtg cgcagggcgg aagccatcac ctcggcatcg cggctgtcgt ccttggcacc 427501
ggccatggtg aagcggtcgc ggaaacgatc catttgcttt ggattaatgg cattcacctt 427561
gaacccgcgc tcaatcagcg tctcgaccac ggggccgtgc ggcacctcga ttgcgacctg 427621
gatttcgtcc ccctcaaccg cgccgctcgt cgccatcagc caggccgcca tttcggcgag 427681
cccttcgccg ccgtgcctga agaccctttc gccgattttt cggccatcac cgtccgtgag 427741
gaacacatga tggctctccg acgcccagtc gacgccagca taacaatgtc tttgatcagt 427801
catgccttct ccccgttcga gcatacgagc caccgcgatc ttcgccgatc cctgtactgg 427861
cgctcggaaa agcacaggtc cggcgcgaac tccccacggg gcatcgatca cggccaatcc 427921
gacggggcac gtgtcccccc caggtgctcg aggcacaggg ggcgatgggt cgctcccgac 427981
gaatcggctc ggttcaggaa ggctacgcca attcgggccg tcgcccatgg tgcacgccac 428041
gttccgccac gcttcacgtc gcgcgaccca cgtcgagcat ccaagaaccg catgagaagg 428101
gtacaggggg ttggtcagcg tccatcagaa atcataggag gaagcacgac gtgcatgcaa

Figure 3 (Cont.)

428161
tatcacagca tccgagtcag cccggcaaga cacaatctcg acgcaacgct cctcaagcgg 428221
ttacaggtgc gtgatgcaaa cgaattctgc tggctttctt gaaagcgtag acccaaaact 428281
tccgccatgc catgtcgttc cttgatctac cggaggggct gccagaacgg atcatccagt 428341
gcaactctcc ctacacggtc cgcttcggtg tacggctgcg cggccgcatg tacagcttca 428401
tcggctggcg atcggtgcgc gagcactgcg aaccagtgaa gggcgacatt cgatatgcgt 428461
caaatgctga cgcagaggag gtcgaggcgc ttgccgcact aatgacgctc aaatgctcgc 428521
ttgttgacgt gccgttcggt ggctccaaag gggcactcaa gatcgacccg cgaggatgga 428581
ccccgcagga gctcgagcac atcactcgac gctttacgca ggagatgaac aagcgccccg 428641
atcgggccag gcgtcaatgt gtcggctccg atatcggcac cggtgagcgg gaaatggcct 428701
ggatgatgga tgagttccgc cgcgccaatc ctaccgacgt ggtcacttcg ggtgcttgtg 428761
tcaccggtaa gccgctgtcg aaaggcggga tcgccgggcg agcggagtct acgggcaggg 428821
gcgttcaatt cgcgatccag agctcccttc gggacacccg cacgccgggt ttggatggcc 428881
ggcgcaatct caaaggcgcc tccactgtta tacaggggtt tggcaatgtc ggctatcacg 428941
ccgccaggtt tttgtccgaa gaggatgatg cacgcgtgac cgttcttgct gaacgtgacg

```
ggtatgtcgc caatccggaa ggcctctcca ttgaggccct caagcaacat cagatccgaa
429061
caggcagcat tctcggcttt gatggagcca agtccattgc cggcgatatg tgcggcgtcg
429121
aacagccctg cgacgttctg attccagcgg cgatggaaaa tgctattcat gctgaaaacg
429181
cggagcgcat gaaggcacat ctcgtcgtcg aagccgccaa cggacctgtc accttcgaag
429241
cggacgagat ccttcgctcc cgcggcgtga ccattcttcc cgatctttat gttaatgccg
429301
gaggtgtcgt cgtcagttac ttcgagcggg tgaagaacct cacgcacatc cccttcgggc
429361
tcatggagcg gcggcggcgg gaacggggca accacacaat cgctacggcg cttgaacgga
429421
tgacaggcaa ggagtccccc gcagacatgc gcgacgaatt cctcgaaggc ggcgccgaaa
429481
tcgacctcgt tcgttccggc ctggaagacg tcatgcgcag cacctggacg cgcattgccg
429541
acctgatgga acagcaaccg gaactcggtg actacagaac tgccgcctat gtcgcgtcta
429601
tccggcaggt cgctgattta tgaggcgatt gggatatgac cgcgtatggc gaaaacagcg
429661
tgcggcgcta ccgactacgc ttactctcac gcatggctcc actcccggcg atgcatgccc
429721
aagtggcgag tatcatcggg ggatatcgca cctcttcttc gatgggagcg aactctacgg
429781
ccatcacagt cgagcgcaga gaacatgtgt ctggaggcaa agtggcttca gcgctacggc
429841
```

Figure 3 (Cont.)

gggggtcaa ttcttcgatt cgcttgacaa aacccacgag aactggatgg aggccaaccg 429901
atacatcgac atggacgatc tcagagagca caagaagctg gctctccgca acgccgcatg 429961
accagcccca tcgccgcccc aatttgctga acttgacgca cagaacctca ttttgacaag 430021
gcgagcttcg gggtgctgg tgcttctagg gctcggcgca ttggtttcgt tcccgagttg 430081
ccggccagtt gtccgatagc ttgggtgccg cgcgggtcgg ccgaacgatc gctatccttc 430141
ctggtttcga tcgccttttt tgggcttgcg ccgacaatac cgctgctggc gatcgcgctt 430201
tggcatgtgt catggttcga tggacatggc gatgaacaga tgggtgcgga ttccgacgat 430261
cgcgcgcatg cattccaatc tgatgccgcg caccgttccg atttgatcgc gcgcatgtga 430321
ggcgaccaat cgttgggggt taaatgggac tacgaactta tcctggtcaa gctggcgccg 430381
atgagatcgc tgtggacggc tgaagactgc ctccaacgga gcgaagcagt ccggcgccgc 430441
gcttcccaac gcgccgtagg ggccggtctg cttcgcgggc ggcgtgtccg acattctttt 430501
ggccaggata ttgtccacgg gtttggggtc cggcctttca ggtctggatt tcggccggtt 430561
gacgcagccg acgcatcgat tcgccgctca tttcaagcct gtgagcgttg tgaaccaggc 430621
gatccaatat tgcgtcggca taggtggggt cgctgatttt ttcgtgccat cgggctacgg 430681
ggaattggct ggtgacgagc gtcgagcgtc ggccgtatcg tccctcaagg atctcgagca

Figure 3 (Cont.)

430741
gataatgggg agcattaccg tcgatgggct gaagcccgta atcatcgagg atgagaagtt 430801
cgacggcgcc gagacttttc aggcgcgttg cgaggctgcc gataccgcgg gcctgttcca 430861
ggctctgcag caatgccggc atccggacgt aaaggaccga atgattgtcg cggcaggcct 430921
tgtgtcccaa ggcacaggcc aaccagcttt tcccgatgcc ggtcgggccg acaatggcac 430981
agttctcgtg ttttctgatc cagtcgccgg caatcagcag gtcgaggatg gtgcgatcgt 431041
attcgcgcgg tgcacggcga atgatatctt cgggaacagc gggatggtgc agtttcgcgt 431101
tacgaagtcg gagcgcaaga cgcttgttgt tgcgccaggt ggcttcctga tccaagagca 431161
gcgccagcca ttcgccatga ctgaggttgt cgctctcgtc attatcggcc agtcttgtga 431221
aggcgtctgc cataccggca agccccaatt gctgcagcag gttgagggta ggatgtttga 431281
gcatttttat tcctttcaat ggtagtattc ggagccgcgg aggttggaat gctggatcgg 431341
ttcctgctcg aggcgctcgg accttgggag gcggtcgagt tccttttcga gaatggattt 431401
gatgccggga tagttgagca cctggaattc cagcgcgcgc tgcgcagccg cttcaaggcg 431461
atcgacgcca aaccgtcttt ccaggccgat gatgccgaca caggcacggt atccctgttc 431521
gggatgcgcg cgcttctcaa tgatccgatc gacgagaacg cgcagcatcg gcccgatccg

Figure 3 (Cont.)

431581
cttggcctcg ctgcggatct tcgccggcgt ccattcgcga taacgctgat ggtttggcgg 431641
catatgcacc gcaaccgtcg tgtggcggcc gttgctgctg ccacgcacat gcgcggcaat 431701
tcggtcgccg ccgaggaata tttccaccgt gcgaatggtg tatcgaacct cgacttcgct 431761
acgcgcaaag cggtaaggga cggaataaaa atgccgactg agttcaatat gataatcgat 431821
gccaacacga caccgacgcc attccgcatg cacccagggc tcggcaggta gcggcttcag 431881
attcggggca tcaagttcgt caaacaacgc gcgccgcgtc ttgccgtact ggcgtatcac 431941
ccgttcgtca ttgagccggg tgatcagatc ggcaatggcc ttgttgagat cagcgaggct 432001
ataaaaggtc cggttccgca gccgacccag aagccaacgc tctacgattc cgacgcaatt 432061
ttcgactttt gccttgtccc tcggttttct cgggcgtgct ggaaaaactg ccgtgctgta 432121
atggcgcgcc atatccgtat aggaacgatt gaccatcgga tcgaagtgac aagccttgat 432181
caccgcgcat ttggtgttgt cgctgaccag gagttgcgtc accccaccaa aaaaccggta 432241
ggctgcgttg tgcgcctcga tccagtcggg caactgttcg ctccacgtcg ccagcgcgaa 432301
cgacaggctg gacgccccca tcaccgccac gaagatatgt gcgtcccgca ccacgccggt 432361
tttgcggtcg acgactgcca ccttgtcacc ggcataatcg acaaacagct tctcgccgcc

ggcatggctt tgccgcatca ccagaggcag ccggccatgc cagtttcgga acaactcaca 432481
gtatctcgaa tatcggaacc cgtctggatc ccgagcaatg tactcctccc agagcacctg 432541
caacgtcaca tgcttgcgct tcaattcgcg cgcgacggca gaccagtcgg gctcggactg 432601
cttccgacgc ccagctttct taccgggcgt cccgtaaagg cgctgctcca gctcgcggtc 432661
actgatcgta tccggtaaag gccatgtcag tccttcccgg tgcaatcgct ttaacgtgtc 432721
gcggaccgaa gtctccccga cgcccagttg cttggcaatg atgcggttcg aaagaccgac 432781
atccagccgc agtttcaaaa tctcgcgcac ctggcgcatc aggagtctcc tcgtcggcaa 432841
ttcacttctc catggcgttg cttccacctg gagaaataac cccaacgatc gggcctcacg 432901
atatcgactt actgcgcgcg attatctcgg aatgctgcgc ggagaattgt cggaatggtg 432961
cgcgtcatca tctcggaacg gtgcgcgcga tcaaatcgga atggtgcgcg cgatgagccc 433021
ggattccgca cagatgggcg agcgaggtgg agaaacacat gaggcggtca gtgatgtcgt 433081
cgtttcaggc catgtggagt gtgggggctg ttctgggcgc agcaaacagg ccccagtata 433141
cattcatttc cttgttactg ccgtgatgac cggcgggatc ctcggaccct tccttctgct 433201
cgattggcga tcaactatcc agacattcat agaaataccg ctggaccgtt gagcagggcg 433261
gaaagtcctt tggcaacatc cgccattggc agcccgttga ggcgatatag cagcgcgttc

Figure 3 (Cont.)

433321
acaacctcgc gcaaatcggt cttgcgcggg cggccgagac ggcgcggcgc aggcacgaac 433381
ggtgcaatat attcccattc gcgatccgtg acatcgcttg catatcagct cgtccgacgg 433441
atataattcc gccgggtggt ttcagtccaa gccatcgtag gctccatcga atcttcgcaa 433501
atccgacgga atcacaactg actgaaatca ctcaattctt tttgggcagc ctcttagacc 433561
tcaattcccc acgtcacagg atacttgcct ttgcagcagg catggtgggt tccttcgtta 433621
gcgggttggg caggctcccg cgggatcgac tgcgcggacg ggatctcagg tggtttttcg 433681
accggcaggc gcactgcggc aggtcggtat gcttgcgaat cacgcatcgg cggcaaaggg 433741
gaacggatgc tccaagtcaa gatggcaaca aggcatcaag cagatcggag gcaacagtgc 433801
tgttggaggc attcgagggc acaggttcat ccacgccggg tcaacccacg tttggctggc 433861
tcggaagcca gtgttgtatt catgaggttt cttttcgcgc ggcatcattc acgatcttcc 433921
ttgcctccac ggttacgggt aggctggtgt cttccggaag gtcgggcagt aagagccgcc 433981
agccatttct gagcaccaca aagccgcccc acaggctttc attctcaacc ttgacaatcg 434041
gctcttcgat atctttcttg ggaacatacg ctgacaagcc gctgccgctt ctgcggatcg 434101
ttaccctcat ctggcttttc cttcgttgac acccctggcg cattcagtgg tttttggcgt

Figure 3 (Cont.)

434161
tgaggtcccc ccgaggctcc tcagttcacg cgtacgcatt ccaacgacga tgccgcgatc 434221
aatccattcg acggcataaa tgtagaactg ctggagaaat gtccctacat cgcgcacaaa 434281
acccgcgtcg cctttcctga cgaggcgttc tccgatttcc ttcccgggat aggtgccgtc 434341
attttttatg tggcgtgtgg cacaaactct ctcacccggc ataaatcgtg gaggattgtg 434401
gatttcgact tcctcttcgc gtccaatact cattaccatt cctcttgtgg ttgcgattac 434461
caggggggaga ctcaaggtcc ggccgcgcac ggaagcccgg ctatggcatt cggggcttaa 434521
gccggcacgc aggtcttcgg catgggacat acagaggcgc attgctgtat ctcgaaaacg 434581
cccttgcatt cggtgcattt cttcggatct atcacgtact tttcgccctt taactcgata 434641
gcgttggaag ggcattcgaa ctcgcaggcg ccgcactggg tgcactggga tgcgatgatt 434701
ttgaaggcca tattattcag ctcctggtta ggtctcgatc gatgggccaa gctcaagccg 434761
ttgcctgcga tggggcggta ccaaactctg tcgcgtgaag agcgctgatc gcggcctcga 434821
tgtagtcata gccataggtg tccgttgccc ggatcccagc ttccatgagc ctctccttcg 434881
gacaatctcc tatccttgcg cagagcacga tgtctatgcc gtcgagtgca gcgatgatgc 434941
cagcgagggc ggcgtcctcg ccccagccgc catggcaata cggctcgacc ttgcggtgcc

ccacgaattt aatccctgtt tgcgaggctt cgtaaacctg gaactccttc gcatggccga 435061
agtgttcatt gatgcgtccg ccgcctttcg ttgcgacagc cacctgaagc gatccacgga 435121
tgttcgcaga tgcgaccgtt gcgatcgctt tctccttagc ctctaaatgg tcatcgcgta 435181
tgcgtgcgac cacctcccgg taggcctgac gcttggcacc gtcgtaatgg ggttcgagcg 435241
gaacgtggtc gagcgtgaac tcctggccac ggtcagtgcc gagaaggccg actgcatcgg 435301
cacggcactg tcgacagtga cgcatcagct tggcaccgcc ttcaagacgg tcgtgaagcg 435361
ccttcagttc gagcgcattt gggccgcgct gtccggtcag gccaaaggag gttccgtgtg 435421
ccgggtctga aatcagcggc atgacattgt gcagaaacgc gccgcgctcc ttgacccatt 435481
tgttgacctc gatcaggtgc aggtcattga cgccggggat cataaccgaa ttgatcttgg 435541
tgaggatgcc gcgtgcggtc agcatctcaa gtcccaacat ctgctgctca tgcaggattt 435601
tggcagcatc cacgccggtg tagcggcgat gcccataaaa gatccacggg tagatcttct 435661
cgccgacggc ggggtcgacc atgttgatgg tgattgtcac gtggctgacg ttcatttccg 435721
ccaacttgtc gacatgctcc ggtagagcaa gtccattggt ggaaatgcac agcttgatgt 435781
ccggaatctc gctggcgacg cgttcgaaag tcgcccttgt cttgttccag tcgtagcaag 435841
catcgcccgg gcccgcgatg ccgagaactg aaagctgcgg cacttcgttg gcgaccgcaa

Figure 3 (Cont.)

435901
ccaccttgcg cagcgcctgg tcgggtgtca gcttttcgga tacgacgcca ggccgacttt 435961
cgttggcgca gtcatatttg cgattgcagt aattgcattg gatgttgcag gctggtgcga 436021
ctgcgacgtg catacgggcg aaatagtggt gcgcttcctc tgaaaagcaa gggtgatcct 436081
tgatcttctc ccaggtggca gaatccatgt cggttggcct tgaggacgag ccgcaggacg 436141
aggacgcgca accaccggat tttgcggttg tcagcaactg cccagaggat gtcgtgttcg 436201
tcaggctttc aagcgaaatt atcggtgcac tcatcaaacg gctccactgg agtaaaaagt 436261
cgtcgtccaa aaaagcaagc gctgtgccaa caggataata tcgaaatatc aatagtttgg 436321
cgcttcgtgt tcgatttgaa ccaatagccc ccgacgcagt tttgtcgaat tcgcgacaga 436381
agcggccaaa ttggacgata cacccgcgcg cctgaggagg aggggaatgg ccgagcccag 436441
ataagagggc tcaccgtctc tagatttttt tcacctgtat atgatgccgc cgtaaagcat 436501
agccgacttg ccgcggtgtg aggccgagga tccgagctgc cttcgcctga acccagccgg 436561
ccttctccat cgcgctgatt agcagctcgc ggtccgatag atgtggtgcc accgttaagc 436621
cgccagggcc ggcggggtaa ccgagactgg ccggcgattc gactggcaaa cgtttgctca 436681
tggccaatcc attgagcgaa tggctgccaa gcggtctgtc agcagttttc ccgagcattg

Figure 3 (Cont.)

436741
aagaaaagca ctggtcattc tggcaggaga aatctgatgg aacaatcgtc gccgaacgtg 436801
cgagagtggc ggtcctgcgg acgcagtttt caagctctcg gacgttgccg ggaaatttgc 436861
atcttgacag gatctcgagt gccgcaggcg tgaattcgag attgcgattg ttttccctgt 436921
tgaaccggtc gaggaaaacc ttcgcaaggc gtggaatatc tccatttcgc tccctgagag 436981
gcggtaaaaa gagaggcact acattgatgc gataataaag gtcagcccgg aactccccct 437041
ccgccaccgc cgtctccagg tccttgttgg tggcgcatat gagtcggacg tccaccttga 437101
gcgtttttgt gccgccaact cgctcaagct caccttcctg caagacgcgc aacagtttcg 437161
cttgaaaggc cggcgagatc tcgccgattt cgtcgagcaa cagcgtcccg ccatccgcca 437221
gttcgaaacg gcctgcgcgc tgagagatgg cccccgtaaa ggcgcccttc tcatgcccaa 437281
acagttccga ttccaggacg cctgcagaca gtgccgcgca attcaacttc acaaacggct 437341
tttttctgcg aggtgaaagc tcgtggattg cctttgcaaa gaattccttg cctgtgccgc 437401
tttcgcccct gagaagcacc gcagagttgg tttgtgcaac gactttgacg ctttcaacca 437461
cttgcctgag tgcggggctt tccccgacaa tccagtcgat tctcgtaggc cgttgtcggg 437521
ttggttcagg cagttccttg tcgcctccac taatcttgcg atcgccctcc tcgccgatcg

```
gtcgactatc gcggctctcg tggccattca gccgaaccgc tcgtgccgca aggttggcga

437641
ccatcgacag gaaacgcacc tcttcctcaa attgtgttct ggtggctgcg ccatccttgg

437701
cgcggtcgat ccataatgtt ccaagcgttt cttgatcggc cttcatcggg acaccaatga

437761
aggtgacttg gccagtgccg ctcacgatac tctgaagctc atcctggaac agttccgact

437821
tgcaagtgtc cggtacgacc agcggcgcac cttttgcgac gattctatct attgcagcct

437881
tcgcagcaat gtggcgcgcg cctgatgatg gaggctcaac cccgaacgtc gcagttgtct

437941
cgggctctcc ttcagcgcca acaacgacga ttgcgccgcg ccgcattggc aaaagtgcgg

438001
ggagggtgtt aatcacattg gcaagcttga tctcgaggct ggctgaagtg atcaaaacct

438061
tcgatatccg atagagaccg ctgcacccca agtcccgttt gtgcatggtt ttaggggata

438121
attcagtcat acactcatcg agccaattct tacgaggaaa caccttgagc gtcgtacgaa

438181
cggcccttgg ctccctacga gaaaatgccg ccttgctgac attatcaagt gcttgcgctt

438241
gcacctgtga gcgcccgtca acgtacccat cttgttagac aaaagtgaga tgcaagtcat

438301
ccgaatttaa agagcacacc gaatccacct cgcggatagc tccaatcaat gtcaccgctc

438361
tcttcgcaca gtactctaca tgtcccgcat tccatgcatc catccgcaat aacctctact

438421
tggccgtctt cattcacctc gtagcatttc gctgggcaaa caacggtcag cgcaagcagg
```

Figure 3 (Cont.)

438481
tttgggctcg gagactgatg ctgccgcacc ttgatgtgcg gccgccccgc gtccaccagg 438541
taacggtttt ggtaaagctt gtcttcaatg cgaacgactg aagctgtcat ctcaatgctc 438601
ccctttagcg ccatgccagt gccaagcgga ctgcgtcgct gaccagtccc catcgcgaac 438661
gcgctttaat aagagcggcc gtggtcgctc tttccttctc gatcttgggt gtgccgtcga 438721
cgcgcacgaa gttttgcgcc gcctgcgaca tcaactgcgg ataagtcgtg aagaaattgt 438781
gtgaattcgt gtggagcaga gcgggcatgt ccttgtactt tctgaggtct ttcagaacga 438841
aagacttgtc cagcatggcc ttgtaaagtg agagattgtc actcgtcatc gggtgttttc 438901
ggctcttgat tgcggcgatc gcctcgccgg cgatgcggcc cgacgtcatg gcgaggttcg 438961
agccctcgcg gtgcacggcg ttgttgagct gcgccgcgtc gccaaccacg acccagccat 439021
cgccaaagag ctgcggaatt gccttgaatc cgccctccgg aatgaggtgc gccgcatatt 439081
ccttaatctc cgagcccgca agtagcggcc ggattgatgg gtggttcttg aatgcgtcaa 439141
gtagcgcgta aggactttcc agggtcgctg cgaaatggga gacaaggcag ccgatgccaa 439201
gagagatcga ttccttgttg gtgtagagga atcccaagcc ggccattccg cgcgagattg 439261
tccctgccgc ctcaataaca cagccttgat cgccggtaag gccgaagcgt tcattgatga

Figure 3 (Cont.)

439321
cctcttccgg taggaaatgc atttccttga cagcgagtgc cacggcttcg ggtttcggca 439381
ccttgcgaaa tcgtgctctc gtgccgagga ggccgtttac gccttcggcg agcacgacca 439441
cgtccgcatg gatgaccccg cccgctcgat cggtatggac gcctatcacc ttgccggcag 439501
catcaagagc cagttccgtc accgtcgtct cgcacaaaac tatcgcgccc gccgctcgga 439561
ctttccgcga aaaccacttg tcgaactggg cgcgaatgat cgtgtaacgg tttggcgccg 439621
gctcattgaa gtcgtccgac cggtagtgca ttccggtgtg tgacgtgtcg tccgttaccc 439681
agaatcgctg ctcgaccaga tgccgctcaa gaggtgcatc atcccggaaa tcgggaatga 439741
ttgtctccag catgttggcg tacaagatgg cgccttggac gttcttggag cccggatatt 439801
ctccgcgctc caactgcaac acttttagac cgcgacttgc catggtgtat gcagccgcgt 439861
ttccagacat accggcaccg acgacgatgg cgtcgaatct ttcttcggtc ataggtttta 439921
cctcagttca caactctcag acgattggcc ggcgccaacc gtttggtgaa agcttccgtc 439981
aacgccggca gaaagctgac agcatcggtg acaacaccga catgggcgaa atcgaagatg 440041
ggcgcgtgtg gatcggtgtt gatagcgaca atcaggtcag ctccctcgac accgacgcgg 440101
tgctggaccg cgcctgatat tccagccgct atatagagct tcgggcggat cgttttgcca

gtttggccga tctgccgatc agctggcatc cagccctttt ggacgagcgg cctggaacag 440221
ccgtagtcac cgccgatcgt cagcgcgagg tctttgataa gcagcaggtt ctctgcattg 440281
ctgaggccca gcccgccggc aaccaccaca tccgcatagg cgagattggc gttgcccgat 440341
cggtcgtcgg aaaggaaacc gacgaccttc gtgacgatat cttcctccaa catccgccaa 440401
tcgtgccgga ttacccgccc gatcggcttg tttgaccgct gtggcatgcg catgaccctt 440461
ggccgcacag ttgccatttg gggccggcaa ttgagcgtat aaatcgtgca aagcaacgag 440521
ccaccgaacg tgggccgagt agctgcaagc gaaccgtcct cgtcgacatc aagtccggtg 440581
cagtcggctg tgagccccgt cagcagtgtg gtcgccacgg aaccggcgag gtcgcgaccc 440641
agcgtcgtcg caccgagaag cagaatctca ggcttatggg taatgaccag atctgtcagt 440701
gctttggtga aaggctcgtt tctataatcc gtgagcagcg gctcctcgac gagatacacc 440761
agatccgcac cataggcgaa ggcctcagca gcggcgtgca aggtagaatc ccccggaggc 440821
ccgagaataa tacctgcgag ctgaaccccc agttggtcgg caagtctgcg gccttcgccg 440881
agaagttcga acgagaccgg gtggacatgg ccgcgttcca gctccatgaa aacccagacg 440941
tgccggtagt ctctgaattg ctcaggcagg tcctttttca tgctggcacg ggcttgggcc 441001
ggtggtgatg ctttactttt tcgagttccc ataatctgct cctatctgct cacgctacga

Figure 3 (Cont.)

441061
gtggaggaga gctcgtgctc cagtgccggc tgatgggcga agattgaagt gaccagttcg 441121
ttagctacgt cctgcattgc cttctcgacg gtgtcgatct gcaccgcttt ttgctcgcgc 441181
ggggtagggg caaagacccg cttgacgacc gtcggcgaac cgcgcagccc gcattttgtg 441241
atgtcttcaa tgccagcctc caccgcattc cacttgacga tttcgctgcg cgcggcccgc 441301
aaggcatcat caagtgagcc gcggcgaatg gcattcgatc cttccagcat ggtgatcagg 441361
caaggcaatt cgctcttcag gacgtgcgtc ccgccttccg cgcgacgctc gaccgtaatc 441421
gcgcgcgtgc ggagatcaat ggaagtgacc tttgcgacat aggtcaactg cacgaggtcg 441481
aggcgcttgg ctattccggg gccgacctgg gcggtatcgc cgtcgatcgt ctgcttgcct 441541
gtgaagacga tatcaggcga tccaaagcta ttgccaatct tcgcgattgc ctgagaaaga 441601
gcaaatgaag tcgccagcgt gtcggagccg gcaaagtgcc ggtcggtcag gagtatcgcg 441661
cggtctgcgc cataagtgag cgccttgcgt aaagattctt cggccatggg ggggcccatg 441721
gtgagcaccg tgacctcgcc gccatggtgg tcacgcactt ggagtgcctg ttcgagggca 441781
aacaggtcgt aagggttgat gatagtcggc acgccttggc gcatgatcgt gttcgtcacc 441841
ggatggacgc gtatctgcgc cgaatccggg acttgcttga tacagactac gatgtgcatg

Figure 3 (Cont.)

441901
aggtctcttt agctccgatc gcgtgtaaaa tgacgtcttt cgcctccctt ccaagcacca 441961
accatgccaa ccaactgtgg tccaagaagc ccatgaattc taaggagctt tttcggctca 442021
caggatgcga cctgcgtgat agcgttgtcg gcttcatgac atcgaatcgt cgcaaccgct 442081
ccgtacttgt cgttttccga tgatcttagg ccgagtccca atgacaaatg tgcggttagg 442141
cgcaccgctg atccgacgtg aaaacggcga agtggttgca aactccgcgc tttatgtaaa 442201
gtgccccgaa gctcttcggc ccatggcact tgtgcgcgga aagcgacagc atgaagtgtc 442261
ttgctgatcc ttctcgtgga tgacctagca ttctcgttcc cctctgtttc tgcgatcagc 442321
cgaaagactt cccgcaggcg cagttctctc gtgcgttggg gttatcaaag atgaatccgg 442381
cggaatcgac acccgtggtg aagtccacgg tcatgccgct gacatgaggt tgagaggctg 442441
agtctacgta caccttgacc ccacccgcct caatgacagc gtcgccgtcg cgcgactcgc 442501
tgtccaagcc caggtggtat ttaaaacccg agcagccgcc cgcttccact ttgatgcgta 442561
gcccatccgc cggctcgcaa gtctgtgaaa gcgcgaactt tattgcggca atcgcactgt 442621
cggtgagcgt tatcatgggt tcgtttctcc tggtttcgag tcgcttgcga acgatgcacc 442681
tagtgtgcca accagaaacc atcacgaaaa caacgcgttg ttcaaacacg gccatgtcgt

ttgtacgaca cagtcgtagt tacgacattt tgggtgatta aaccgagttc gtgtgaggct 442801
ctccgcgacg cgccgagcat cgacgtttat cctcggcagg ggctgctgag actccggcgc 442861
ggagattgga tacccggtcg attgaaggaa actaaaccct cagcgggaat gtgccgtacc 442921
gttccgtgcc gcagcatgaa ctgctccggc gcaatacctt catgtcggtg tacataggcc 442981
aaatgctcct cttgcgaacg cgagttcgat cacgacatca attgtgatga cagacttgct 443041
catgggaact cgcctttaac ttcggttccg tgcccgaaga gcggcatagc aggaagcagg 443101
atctcggtga aatcgattat ctcgatggca cgcattagct caatggatcg agggatcgtc 443161
cgcggagcgg accggcaagt caccttgagc ggcgattttc ctgctgcgcg gggttcatga 443221
aagtgcgctg gaggctgctc agtgggtagc tgcggcgctc actgtcagca ccggctccgc 443281
aacatcagac tggatagctc acatggcaaa aatcaaaatt taatcgggac acgaccgaga 443341
cgtgcggtgt cgaaagtcct cagcgtttca agaatgttct gcggagaaga tgcccaataa 443401
ggatccgact cgcagttgtc cgagaaacct tcttcttcga accattgctc caccacgcta 443461
tcattgacca cggcagcgta gcgccacgag cgcattccga agccgagatt gtcctttgca 443521
accagcatgc ccatcttgcg agtgaattcg cccgaaccat ccgggataag cctgaccttc 443581
tctaagccca acgccttgcc ccatgcgttc atgacgaagg cgtcattaac tgacaggcag

Figure 3 (Cont.)

443641
tagaccgctt cgattcctac cttcccgaat tcgtcgtaaa gtctctcaaa gtcaggcaat 443701
tgctgagttg agcaggtcgg ggtgaacgca ccgggaagcg aaaacagaac gacgcgcttg 443761
ccactgaagt aatcctcggt tgtcctgact tcccatcggt atgggtttgg ccctcctatt 443821
gtctcgtcgc gaacacgcgt gcgaaaggca acgaaaggga ctcttttttt cacaggcatt 443881
gaacatcgct ccttcaaaaa agaactgagc attcgccgcc tctggaccct ctggcgaagc 443941
accgttactt aaataatcag ttcgtcggcc aacgaacaga cagcaagcgg cgtgccactt 444001
tagatccaag cttcaacagc actgcttttg gtacgggcat ggcaatcttg tgcgcggact 444061
ggcgcacctt ctcgtgcgtt tccggttaag aaactcgacc gctgctcttg tcagagagcc 444121
gacatcatgt cgcctttgtc gtccttccga cacgccgcat ttccccctgc ttcctacaga 444181
cctccgttta gcctttgaat ggaacgcacg aacttaaccc ttcggctcag cagactggat 444241
tggcacgaat tttgaaacgc ccccgggggg cacaattgcc gtgcaggcat ctctggggcg 444301
ccctcgtgtg gaacgaaagc agggaaggat gggaacatgt caaatctagc tcaggtgcgc 444361
gctttgtcga aagggagagt aacactcgga atcagaatga ccgatcggcc cggttggcga 444421
cagttatccg aattgctgga cctcggaccc tggccgccta cggacctcga aatggatttc

Figure 3 (Cont.)

444481
gatcagtacg tgtttgcatg tgtcctttcg cgtgcactcg aggaaatcga tgccggcgag 444541
gcaactgcaa cagaggcaac tggtctttcg caagtagagc tgcgggacat cctcaaccgc 444601
agttttcccg ccccaactat tcatgttttt cgcttggaag aggtgagaga ttcggagccc 444661
ggccccgagg aggcacttct gcgcggtctg ctgctcgcgc atgctcgagc gggcgattcg 444721
gcgagcgtgc tgttcgccaa aatcatagcc cggcgtgcct tgcgccacga ccatctctgg 444781
agggagcttg gtctttttga tcgagtcgaa ctcagccgat tgctcgccag ccatttccca 444841
acgcttgcag ccggcaatac ccaaaacatg cggtggaaga agtactttta tcgcaagctg 444901
tgtgaggccg agggctattc gctgtgcacg gcgccttctt gcccgcaatg caaggaattg 444961
gagagctgct ttggctctgg ggaaggcgaa agtgcttcac cagtcgggaa agttggcgga 445021
gaggcttgag ctcaagcgcc gcctaggtcg gctatagacg gctgggaggc cttttcgtca 445081
tctctgcatg cgcggattac gagtgtgcat gcaccaagtg gaggaaatca tcttgatcgt 445141
agaaaacttg gcggaggtcc gcggcaagac accccattat agacatctat acgtccaggt 445201
cctcgcggcg atcgccgtgg gcatcctgct cgggtatttc tatccggatg tcggctccaa 445261
gatgaagccg ctcggcgacg ccttcatcat gctcgtcaag atgatcatcg cgccggtgat

cttcctgacg gtcgcgaccg gcattgccgg catgaccgat ctcgccaagg taggccgtgt 445381
cgccggcaag gcgatgatct acttcctgac cttttccacc ctcgcgctcc tcgtcggcct 445441
cgtggtcgcc aatgtcgtgc agccgggtgc cggcatgcac atcgacccgg cttcgctcga 445501
tgcaaaggcg atcgccacct atgcggaaaa ggcgcatgag cagtcggtca ccggcttcct 445561
catgaacatc atcccgacga cgcttgtcgg cgcctttgcc gagggcgaca tcctccaggt 445621
gctgttcatc tcggtgctgt tcggcatctc gctcgcgatc gtcggcaaga aggccgaggc 445681
cgtcgtcgat ttcctgcacg cgctgacgtt gccgatcttc cggctggtgg caatcctgat 445741
gaaggccgcc ccgatcggcg ccttcggtgc tatggcgttc accatcggca agtacggcgt 445801
ggcatccatt gccaatctcg cgatgctgat cggcaccttc tatctcacct cgttcctgtt 445861
cgtcttcatg gtgctcggcg cggtcgcacg ctacaacggc ttctcgatcg tcgcgctcat 445921
ccgctacatc aaggaagaac tgctgctcgt gctcgggacg tcctcctcgg aagcggcgct 445981
cccggggctg atgaacaaga tggagaaggc aggctgcaag cgctcggtcg tcggcctcgt 446041
cattccgacc ggctactcct tcaacctgga cggcaccaac atctacatga cgctcgcggc 446101
gctgttcatc gcccaggcga ccgatacgcc aatctcctac ggcgatcaga tcctgctgct 446161
cctcatcgcc atgctgagtt cgaagggggc agctggcatc accggcgctg gcttcatcac

Figure 3 (Cont.)

446221
gcttgccgca accctctccg cggttccctc cgtgccggtc gccggcatgg cgctgatcct 446281
cggcatcgac cgcttcatgt ccgagtgccg ggcaattacc aacataatcg gcaatgcggt 446341
cgcaacgatt gtggtggcga agtgggaagg cgagcttgcc ccggcgcagc ttgcaaccac 446401
ccttgcaggc aaggcgccgg tggagaccat gtcggggttg tcaagccagc ggagtgacac 446461
tgttgaactc ggacaaaaag tgctgtttgg tgcaaccaat tccgcagatc gtactcttgc 446521
cggtcgccca ggggggcgcg attcccgtcg aattgctccc gatcattccg ctcaggtctt 446581
cggcggtccg ctaagcttat gagtgactta aggagaaagc gagtgaagac caaccccatc 446641
ccggatcatg ttccgcccgc actcgtgcgg cacttcagtc tcttcacgtc gcctggcatg 446701
gcgccgacgc ctaacgggga tccgcacgcc gccgtggctt gcgttcatga tgatggcccg 446761
ccgatctttt actctccttc caacacgcgc gatggacgag gtacctgggt gataacacgg 446821
gcgagagacc agcgccgggt ccttgaggat acagagacct tttccagcca tcgcagcatc 446881
ttcgcctcgg cacttggcga acactggccg gtcatccccc tcgaattgga ccccccggcc 446941
catggagtgt ttcgtgcact gctaaatcct ctgttctcat ccaggcgggt gttggcgctg 447001
gagccgacta tccatgccag agcaggcgcg ctgatcgact gcattgcgaa agagaagacc

Figure 3 (Cont.)

447061
agctgtgacg tgatgaagga tttcgccttg ccctttacgt tcagcgtttt cctcagcttt 447121
ctgggacttt cccagaggcg atccgaagta cttgtcggct gggtaagcga tttgctccac 447181
ggcaacgcag aaaagcgaag ggcagcagcc cgctcggtcg tggcctttat tgacgaaatg 447241
gcagcgatgc gccgcaagtc gccagctgtc gatttcatga ccttcgtcgt tcaggcgaaa 447301
atcgagggcc gctccttaac agaagaggaa gtccgcggca tcggtgtgct tttcttggtc 447361
gcggggctcg acacggttgc cgccgccatt ggctttgaca tggcctatct tgcacgcaat 447421
ccaaagcacc aggagttgtt gcgaaacgaa ccggctcggc tcgggctcgc cgctgaggaa 447481
ctgctgcgcg cctattcaac cgttcagata atccgcgtgg ccacgaagga catcgagttc 447541
gaaggcgtgc ctatccgtga gggtgattat gtttcctgtc ccgcgatgat tgctaatcga 447601
gatccgtctg aatttaagtg ccccaacact atcgatctgg cacgacagga taaccagcac 447661
accgcctttg gctatggacc acacctttgc cacggagcgc atctcgcacg gcgagaaatc 447721
gtcattggcc tacgtgaatg gttagcgcgc atcccagctt tccgcatcaa ggaaggtacg 447781
gcgccgataa ctcatggcgg ccatgtattc gggatcagta atatcatcct aacttgggcc 447841
tgattggacg ggcgaggcgg tagcaatgaa gcgccgatcg ctcccaggtc ttcatcgctt

accgcatctc accgcaccat gatgaatgaa gaaagcataa ccaatctatt cgaccgagaa 447961
gcaatccgcg actgtctcca tcgctactgt cgagggatcg accgggcaga cgaggctgca 448021
ctgcgcagct gttattggcc cgatgcgcgt gacaatcacg gaagctactc cggctctgcc 448081
gcagggttta ttcagcatgc actcaacgtc ttcaaaacta agccgcgcaa catccaccag 448141
cttacgaaca taatcattga gttcctgggc gcgacagagg ccgccgtcga gagttatttc 448201
accgcgctgc agcgcggtca cgacgcaaca ggcgagataa agcaggtgct cttgtgcggc 448261
cgctactgtg atctgtttca gaaaagggaa ggggagtggc gcatcgtcga acggacggtg 448321
gtctatgatt gggttgagaa acagagacca ccgaagtcct cggaagcaga gcggttcggt 448381
cctcgccaac cgattggggc accgcatccg aatgatcccg tttacgaact ttcgaagcgg 448441
cgagttgctg cgaaaaatca tccaaaggac ctgatcggca gtggagaaga agaaccatga 448501
tacgactgcg ctaccctccg attcctcgag gccgagcccg cggagcaaag agacgcatgg 448561
acgatcgcca ggttcagcca gggcgggtca tcgtcgtcac aggtgccgca gggggtatcg 448621
gccgcgcgct cgtcgatatt tttgccgcga atggagatgt cgttgtcgcg gtggacctcc 448681
cggacagcgg cgtaatcgaa cttggccaaa atctcggaga gccccatctt ggcctcgagg 448741
ttgacgtgtc gcgagaggac gatgtcgtcg cattgcgtgc ccttctggaa aagcgattct

Figure 3 (Cont.)

448801
cgcggattga agtgctcgtc aataatgcgg ggattgggcc gaccatggct gcgaccgccg 448861
atactgctct cgaagatttt caacgcgctc tagcgataaa ccttgtcggg gcttattcgg 448921
tggcgtgcga aaccgcgaag ctgatgaaac ctggcgccgc catcgtcaat gtcgcttcgc 448981
tggctgggct gctcggcaat ccgaagcgca gtgcctacgc agcttcgaaa gcaggtctga 449041
tctcaatcac gaaatcgctg gcgtgccgat gggcatcgcg cggcatccgt gtgacagcgg 449101
tagcgcccgg tcacgtgcgc acgcctatgg ttgccgaatt ggaacgcgct ggcaagctcg 449161
acgtcagcgc gataaggcgc cgcgtaccgt tgggccgaat agcgcgcccc gacgaaatcg 449221
cgcgggccgt gcgctttttg gcgagcgcac aggcgagcta cataaccggg tcgacgcttg 449281
tggtcgatgg gggctggatg tcagtcaacc aaccgggtgg tgcccatcag gctcaggata 449341
ggacgcccgg agcagaattc atgcggccgg tcgaggacac cgatgcgcga acagtgatcg 449401
tcatgggcgg cgctacaggg gtaggcgcgg ccatcgctcg gcgctttgcc gaaaacggcg 449461
acacggttgt gatcgccgac ggagacggtg aagaagcggt aaagctcgcc ggcttgctcg 449521
gcgacaagca cctgtcaagg cgcgtggaca ggaccgtcga aaccgaggta gtctcgctct 449581
tcgaagaatt gcgggagcgc ttcggccacc tcgacgtctt cgtcaacggc atgaatgaga

Figure 3 (Cont.)

449641
tactcgtccc caataccgag gagtcgccgg aagtcctcaa acgcatactg gatgtcaatc 449701
ttactggcgc cttcacctgc gttcgcgagg ccgccatatc gatgcgctct ggcagcgtaa 449761
tcctgaatct cggggcaagt ttaagccttt caccgctcgc gccaagtcac gcctatggcg 449821
catacaatgc tggcatagac atgctgaccc gctgcacggc ggccgaactc gggccattgg 449881
gcatccgcac agccacagtc gctccaggtt acatccgcac atgtgccgcc aaccggctgg 449941
cagcggtcgc cggcatggat tcggcttcgc tccgacagcg aattcctttg ggcagggtcg 450001
gggacgcaga agaagtcgcc gaggctgcct actttctggc ctcgtttgat gcctcctaca 450061
tcaacggctc gatcctgcac gtggacggag gcttgatctc gtccagagaa gcggggtggg 450121
gcagcgaagt cgatggagca atttcggcgg agatgaggcc gcagcgccga cccgcggcgc 450181
gatggcggtt gctctctccc tgaattgcat ttgcacgctt ttagcgcttg gcgctctgaa 450241
tgcgttagga ggccatgagc agggccatag ggaaaccttc tcgtcaatcg aggcgcgacc 450301
cgcgactgcg cgattccaga tccgaaaaca aggagacacc atggagttcg caacgttcat 450361
tctcgctgcc cagcgcggct atcatcagtc ttccgctagc gtcatccgca actcgataga 450421
gcaggcaatt ctttcggagc aggctggctt cagcacagcc tggttcgccg agcaccactt

taacaactac agtctcgtcc cgtcgccact actgatggta gcccactgtg ccggattgac 450541
cagcaccatt cgcctcggaa ccgcagtctg cgtgctgccg ctctaccaac cacagcgcct 450601
gctggcggaa atcggctttg tcgacgtcgt tgccaacggt cgactcgaac tcggcgttgg 450661
ttcgggatac cagcagttcg agttcgaccg cttcggcgtc aatatagatg aggcgccggc 450721
catcttttcg gaatgcctgg acattttgct gaagggacta aagcaaaaaa tcttcaccca 450781
cagcggtcgc tacatgcaga tacccccgac ggcgatttcg gtgcgcaccc tccaaaagcc 450841
gacgccaccg atctggattg ctaccgcatc ctccaaaact atggcccgag cctatcgtga 450901
gggtcacaat cttttcgtca cggctctcca tgacggcttg gaaactctgg gcttgctgcg 450961
tggcatcatt aagaccgccg ctggatccga gggcaaggag gttcgcgact ccaaggtatc 451021
gctactgcgg tgctgctatg ccagtgatga tggagcggaa atcaacagct atatcgataa 451081
cgcccgcttc cagcgccggc tgtccgaggc actgcaacag cgtcggcaac aaagtaagga 451141
cggctatatg ttggaggaga tgccgacgca tcaggatcta tcgttcgata ctatgcgcaa 451201
gaacctgccc attggcagca tcaatcgcgt gattgatcgc cttctggagg agatcgatgt 451261
cttgaagccg gaccagattg caattcagac ccagctgggg gattttgacc aaaagacgat 451321
gttgcgccag atcgagcttt ggggagacaa gataatcccg gcagtccaga aatctctcgg

Figure 3 (Cont.)

451381
gcggtcggag gcttgagttt atatcgtcct gaccttcggg tcagctcact tcctcaggcg 451441
ccgtcagaat gcccggcaag ttttaagagc catcgtaaat gtcggcacag attacagctg 451501
aactcctcgt gaaagttggg cgtcatgggc cgcataccca ttcgcacgac agacaagcag 451561
cctaccggcg gccgtacgca tttgagctcc gatagttcag tccgcgattt taatcggacg 451621
aggccctgaa atacccatct taagttgatc ggacggcgga cacttagtgc tggcaaagcc 451681
tccgagaaga tgcttcccaa acccgcggct tgtacctgat cggcggcagt gggctccgag 451741
cgcctgatag gcaacgctat gcgacaattg ctgggtacaa ttgtcggctc cgcgacacat 451801
gcttgcgttt taatgcgggc gctctctttt tggtctaagc ggctgagaaa tctggaaaat 451861
cgggcagcca accgctgcgc tccaccgact tggcacggct tttgaagcct tccttgtgca 451921
ggcggcttga agctgccgct gtattcgtgt tgcgggcaac cgcgatggtt tcgaacaacg 451981
aaggaaagca acatggcagg tctgcgtcaa atcgcgtttt acggcaaggg cggtatcggc 452041
aagtcgacca cctcgcagaa cacgctcgcc gcccttgtcg acctcgggca gaagatcctc 452101
atcgtcggct gcgatcccaa ggccgactcc acccggctca tcctcaacgc gaaggcgcag 452161
gacacggtcc tgcatctggc ggcaaaggag ggatcggtgg aagacctcga ggtcgaggac

Figure 3 (Cont.)

452221
gtgctcaagg tcggctacaa gggcatcaaa tgcgtcgagt ccggcggccc cgaaccgggt 452281
gtcggctgcg ccggccgcgg cgtcatcacc tcgatcaact tcctggagga aaatggcgcc 452341
tatgacgatg tcgactacgt ctcctacgac gtgctgggcg acgtggtgtg cggcggcttc 452401
gcgatgccga tccgcgagaa caaggcgcag gaaatctaca tcgtcatgtc cggcgagatg 452461
atggcgctct atgccgccaa caacatcgcc aaggggatcc tcaaatacgc ccattcgggc 452521
ggcgtgcggc tcggcgggct gatttgcaac gagcgccaga cggaccgcga gctcgatctc 452581
gccgaggcgc tggcggccaa gctcaattcc aggctcatcc acttcgtgcc gcgcgacaac 452641
atcgtccagc acgccgagct caggaagatg acggtgatcc agtatgcccc ggagtcgcaa 452701
caggcggcgg agtatcgcgc gctggccgac aagatccatg ccaattccgg ccagggcacc 452761
gtcccgaccc cgatcaccat ggaggagctg gaggacatgc tgctcgattt cggcgtcatg 452821
aagaccgacg agcagatgct tgccgaactt caggccaagg aagcggcggc agcggcccag 452881
tgaccgccgc cgcagacgct gcccgggacg gtgatccggt gcgacattcc accaatggtg 452941
cctcttcttg gaggacacgc aaaaaagggg gcaggcccaa tgagcctcga ttacgagaat 453001
gacagtgcgc tccatcagga gctgatcacg caagtgctgt cgcagtaccc acacaaggcg

gccaagcgtc gccaaaagca cctcagtgtc gcatcggacc gcgaggcggt cggggaggag 453121
ggcgagaccc tctccgaatg cgacgtgaag tcgaacatca agtcgatccc cggggtgatg 453181
acgatccgcg gctgcgccta tgcgggctcg aagggcgtgg tctggggccc ggtcaaggat 453241
atggtccaca tctcgcacgg cccggttggc tgcggtcaat attcctggtc gcagcgccgc 453301
aactattatg tcggcaccac cggcgtcgac accttcgtga cgatgcagtt cacctccgac 453361
tttcaggaga aggacatcgt ctttggtggc gacaagaagc tggaacaggt catcgacgag 453421
atcgaggagc tgtttcccct caacaacggc atcaccatcc agtccgaatg tccgatcggc 453481
ctgattggcg acgacatcga agcggtgtcg cgcaagaagg ccgccgaaca cgaaacgacg 453541
atcgtgccgg tgcgctgcga aggcttccgc ggcgtctcgc agtcgctcgg ccatcacatc 453601
gccaacgacg ccatccgcga ctgggtgttc gacaaggcgg acggcaagac ggacgtcgag 453661
ttcgaaaccg gtccctacga tgtcaacgtc atcggcgatt acaacatcgg cggcgacgcc 453721
tgggcgtcgc gcatcctgct cgaggagatc gggctgcgcg tcgtcggcaa ctggtcgggc 453781
gacgccacgc tcgcggaagt ggagcgggcc cccagggcca agctcaacct catccactgc 453841
taccggtcga tgaactacat ctgccggcac atggaggaaa gatacgccat cccctggatg 453901
gaatacaact tcttcggccc ctcccagatc gaagcctctc tgcgcaagat agccaggcat

Figure 3 (Cont.)

453961
ttcggcccga cgatcgaaga acgggccgag agggtcatcg ccaagtaccg gccgctggtc 454021
gacgccgtga tcgacaagta ctggccgcgc ctccagggca agcgagtgat gctctatgtc 454081
ggtggtttgc gcccgcgcca cgtcatcacc gcctatgagg acctcggcat gcagatcgtc 454141
ggcaccggct acgaattcgc ccacaacgac gactaccagc gcaccggcca ctacgtgaag 454201
acgggcacgc tgatctatga cgacgcgacc agttacgaac tggacacgtt catcgagcgg 454261
atccgccccg atctggtcgg ctccggcatc aaggagaagt atccggtgca gaagatgggc 454321
atcccgtttc gccagatgca ctcctgggat tattccggcc cctatcacgg ctatgacggc 454381
ttcgccatct tcgcccgcga catggatctc gccatcaaca atccggtctg ggatctctac 454441
gacgcgccct ggaagaaaat gaccgtgccg acggccgcag ttgcagccga atgatcggcc 454501
ggtcttgcgc ggcacgagga ccgcggcaag accggaaacc tctcgaacat ccctgggcct 454561
aagaggccag atcaagaagg tcaaacacca tgccgcaatc ggctgagaag atactcgacc 454621
atgcgccgct gtttcgcgag ccggaatacc ggcagatgct cgcggagaag aagctgaact 454681
tcgaatgtcc gcaccccgaa cggctcgtca cggaccagcg cgaatacagc aagggctggg 454741
aatatcgcga gaaaaacctc gcccgcgagg cgctcgtcgt caaccccgcc aaggcctgtc

Figure 3 (Cont.)

454801
aaccgttggg ggcggtgttc gcagccgccg gcttcgagcg gacgatgtcg ttcgtccatg 454861
gcagtcaggg ctgcgtggcc tattatcgct cgcacttgtc gcgccacttc aaggagccgg 454921
cttcggccgt ttcgtcctcg atgaccgagg atgcggcggt gttcggcggc ctgaagaaca 454981
tggtcgacgg gctcgccaat acctacgcgc tctacgatcc gaagatgatt gccgtctcca 455041
ccacctgtat ggccgaggtc atcggcgacg acctgcatgg cttcattgag aacgccaaga 455101
gcgaaggcgc agtcccgccc gaattcgacg tgccgttcgc tcacacgccc gccttcgtcg 455161
gcagccatgt cgacggctat gacagcatgg tcaagggcat cctggagcac ttctggaagg 455221
gccaggcgcg cacccaagcg gccggcacga tcaacatcat cccgggcttc gacggctttt 455281
gcgtcggcaa caaccgcgag cttcagcgcc tgctcaccct gatgggcgtg tcctacacct 455341
tcatccagga tgcctccgac cagttcgata cgccgtccga cggcgaatac cgcatgtatg 455401
acgggggcac gacgatcaag gcgctgcggg cggcactcaa tgccgaggcg acgctgtcgc 455461
tgcagcacta caacagccgc aagacgctcg aatattgccg ggaggtcggt caggccaccg 455521
ccgccttcca ttacccgctc gggatcaacg ccaccgacgc gttcctgatg aaggtgtcgg 455581
cgatttccgg ccgggaaatc cccgagacga tacgcctgga acgcggccgg ctggtcgacg

ccatggccga cagccaatcc tggctgcatg gcaagacata cgcgatctac ggcgatccgg 455701
acttcgtcta cgccatggcc cgcttcgtca tggagaccgg cggcgagccg cggcattgcc 455761
tcgccaccaa cggcacggcg gcctggcagg ccgagatgac cgagctgctc gcctcttctc 455821
ccttcggcaa gcaggcaaag gtctggccgg gaaaggatct ctgggccctg cgctcgctgc 455881
tcttcaccga gccggtcgac ctgctgatcg gcaattccta cggcaagtat ctcgagcgcg 455941
ataccggcac gccgctgatc cggctgatgt tcccgatctt cgaccgccac caccaccacc 456001
gctttccgct catgggctac cagggcggcc tgcgcctgct gacgacgatc ctcgacacga 456061
tcttcgaccg cctcgatcgc gaaacgatgc agacggcggt gaccgattat tcctatgacc 456121
tgacccgcta agaacggcgg tcggcaaaac gccggccgtc tcctgatgca atctggagat 456181
tagcgaatgt cttcgctcaa tgtcaaaatc caagatgtct tcgatgagcc tgcctgtgag 456241
agaaatcgca gcaaggattc caacgcgcgc agtaaaggct gttcgaaacc gctgaccccc 456301
ggcgcggcgg ccggaggctg cgccttcgat ggcgccaaga tcgtgctgca gccgatcacc 456361
gacgttgcgc atctggttca tgcaccactc gcctgcgaag gcaattcctg ggacaaccga 456421
ggtacggcgt cgtccggtcc gacgctttgg cgcaccagct tcacgaccga tctcaccgag 456481
caagacatag tgatggggaa cagcgagcgg aagctcttca aagcgatccg ccagattaga

Figure 3 (Cont.)

456541
gaagcgtatc agccgccggc aatctttgtc tatgcgacgt gtgtaacggc acttatcggc 456601
gacgacatcg aagcgatctg caagcgcgct gaggaaacgt gcggcctacc ggtggtgccg 456661
atcaattcgc cgggcttcgt cggttcgaag aacctcggca acaagctggc tggcgaggcg 456721
ttgctcgacc atgtcatcgg cacggtggag ccagatgatg ccggcccttg cgacatcaat 456781
atccttggcg agttcaacct gtctggtgag ttctggttgg taaagccact cttggagagg 456841
cttggcattc gtgttcgcgc ctgcattccc ggtgacgccc gctatctcga cattgcctcc 456901
gctcatcgcg ctcgagcagc catgttggtg tgctctacgg cgttgatcaa ccttgcccgc 456961
aaaatggagg agcgctggga tatcccgttc ttcgagggat ccttctacgg catcaccgcc 457021
acctcggaag cacttcgaca gattgccgat ctgctcgtaa agaagggtac cgatctagag 457081
atcctcgacc gcaccgatgc actcattgcg gaggaggagg cgattgcgtg gaaaaagctc 457141
gaggaatacc ggccgcgact taaaggcaag cgggtgctca tcaacaccgg cggcgtgaaa 457201
tcctggtcgc ttgttcatgc gctgatggag atcggcatgg agatcgttgg cacctcggtc 457261
aagaaatcga cggtcgagga caaggagcgc atcagacagg tgcttaagga cgatctccag 457321
atgttcgagt cgatgtcgcc ccgtgagctc tacgccatgc tctcagaaca taaggccgac

Figure 3 (Cont.)

457381
atcatgctgt cgggcgggcg cacgcaattc attgcgctga aggccaagat gccctgggtc 457441
gatatcaacc aagagcgtca ccgcccctat gcgggctatg acggcacggt ggaactcgtg 457501
cgccagatcg accttgcgat tcacaacccg gtctggtcgc aggtgaggga gccggcaccg 457561
tgggaaagcc gtcctgccac acaggaacca ctgccgaaca cgcgccccga caccgatgct 457621
acgagtgtcg ggcgctcaat tcgccggcac gacgccggtg acttcgttga gtgttgagga 457681
aagcaaatgg tccacatcca tcgccaatct aaatcagcga cggtcaatcc gctcaagtcg 457741
tcccaaccgc tgggtgccgc gttagccttt ctcggggtcg atggcgcgat accgctgttc 457801
cacggcagcc aaggctgcac tagcttcgcg ctagtgctgt gcgtgcgcca tttcaaggaa 457861
acgatcccgc tgcagacgac ggcaatggac gaattggcaa cagtcttggg cggggcagcc 457921
catctggaag aggcgattct gaacttgaaa aagcgggcga atccgcggct gatcggaatc 457981
tgcacgacgg cacttgtgga aacccgttct gaagatttcg caaggcaaat cgccaacatc 458041
aaaatgacgc atgcggagga acttgcaggc acagaggtcg tgctggcaaa cacgccggat 458101
ttcgatggcg ccttggagga gggctgggcg agggccgtcg ccgcgatgat ccaacagatt 458161
acactgcggc gtcagcaggc gcctcgctcg agaaaggcaa cactgatcga gaggattaca

aaacctagcg agcagccgtg gaagcaacag aaggttgcga tcctgccggg atggcacctc 458281
acggtaggcg atatcgagca gttgcgcgag atggtggaag gtttcgggct gaggccggtg 458341
atcgtgccgg acgtctcagg ctccctcgac ggtacggtgc ccgaccgctg gatgccgaca 458401
gcgtatggag gtacaagcat cgaggatata caggagttgg gtagggcggt gcggtgcatc 458461
gccatcgggg aacatatgcg gcgcccggct gagctactgc agacgttgac gggtgtgcct 458521
tacgtgttgg tccagtcgct aacgggattg aagaacgtcg accagtttgt ctcgcttctt 458581
tccgagattt cctgcgtgcc ggcgccggcg aagatccacc gtcaccgctc acagctgcaa 458641
gacgcgcttc tcgacggaca cttccatttc gccggcaaga agatcgcgat cgccaccgag 458701
ccggaccagt tgtaccaatt tgccaccttt tttacgggac ttggcgccga gatcatctcg 458761
gccgttacga ctacgggtga gtcagaaatt atcgagaaag tcccggccga aaaggtccag 458821
atcggcgatc tcggtgatct cgaagatcta gccggcggcg ctgatcttct cgttacccat 458881
tcgcacggtc gccaggcagc ggagcgcctc ggcatccctc tgctgcggat cggcttcccg 458941
atattcgacc gcctcggcag ccagcacaaa ctcacagttc tctatcgtgg cacgcgcgac 459001
ctgatcttcg aggcggccaa catcatccag gccaaccagc ccgcgccgtc gcttgagcaa 459061
atcgatgcaa tgcgaaagcg gagaaatgcc ggatgaattc cgttcgtcgc ctctcgctcg

Figure 3 (Cont.)

459121
tcactgacga aatccagccg cggcgttccg gcgcattgcg catagcgatc gcgacgcagg 459181
acatgaaagt cctaaacgcc catttcgggt cggccaagca ctttgcagtc tacgacgtgt 459241
cgcgcgacgg ctgggatttc gtggaagctg tgagcttcga tgacgtctcc gacgaatccg 459301
ggaagcatcc gatcgagggc gaggaccgca tcaccccaaa ggtgaccgcg ttgacaggct 459361
gtcatctcct cttttgtcgg gctatcggcg gcccttccgc agccagggtc gtctctgcga 459421
aaattcatcc gattagagtg ggagagccgg aagccattca agacgtactt tcacgaaccc 459481
agaaaatgct caagacggcc cctccgccgt ggttgcgcaa ggtgctggcg caagcaggcg 459541
tcgcagagaa aaaaccattc gaggacgagg actgaatcat gaaaaaaacg tccatcaata 459601
cgggcacgcc tgatgtcaag gtggacgagg cggcccttgt cacgccattt gtcaaatgcc 459661
tcgcgcggct ggtccgcgcg caggatacct acggatcgca ggaccgcgca tcggacgcgg 459721
agttgttggc ccacttcatc atcactgaag agcagcgtcg agaaatcccg atcatcggcg 459781
atcccggtcc ggacgtcatg ttgcggttca atatctttta taccgccgtc gcgctttcaa 459841
tcgaagcacg taccggtttg gtagcgtcgc cgatcacgat gatcagccat gagggcttcg 459901
gacgagtgct tctaacgacc gggcggctgg tcgtattttc gaaaacagtg cgcgacatcc

Figure 3 (Cont.)

459961
accgcttcgg cttcgcgaca cttcgcaagc ttgcggaagc cggcgcaaag ctggtggatg 460021
atgcgacggc cgccattgaa acctatcccg aagtggctcg ggcctgacga tcgatccggc 460081
aaaaggcatg ctgccggcgc caaggcgacc ggccaaggat tagggctacg cccgtgggcg 460141
gcttgagggc gagtaaatag tggatttttc cgaaacggag ggtatgagcc cgtgcatcaa 460201
cctcagcgac gcgcgccgcc gtctgccccg ggcagtttat ctgtaccgct tgagtactcg 460261
ttcggtagcc gccgatgaga accatgtgta gtaattcaaa cagccgcttc gacactcttg 460321
tcggtaaagc gacacattct tgtcgactgt tcccttctct gcctcccggc taaatgcctg 460381
aaatgctaac ataacaagct tcttttcaag tcgagcaccc gagtggcacg agtcttgccg 460441
acatgccatc taagaggctg gaaagccggg gatcggcagg gtacgaatga ggcaagcaac 460501
gtggcaggtc taggtcagat cgcattcggc tgcgagggag gcatcgacac gtgcaccgcc 460561
gcccagaata cgctcgctgt ttttttgat ctcggaccga aagtcggtag tgtcggccgc 460621
aacctgaaga gtaactccgg ccgcttcatc ctggaaccaa tgccgcggga cagcgcgcca 460681
gcgtggtacg cgatcatccg cgatttcgat gcggacgtgc cgtggaggct caaagctttc 460741
cacaccgccg ccgggcttgc gatcgaaccg tccgttcgct ccgtgtacga gggcttcgcg

gtgcttctca cgaccgggca gagtcgtatc gaccgaacac catccgtcag tcttccaata 460861
ggaagctcgc tggagaccga agcgataacc gccatccacg cacccaagtg gcgcggttga 460921
cggtcgatct aggcgatgac gaaccgccgg ctctcatttc ccctggagag ccgacgtcag 460981
gcagcgggac cactcctccc cacgcgcacc ggtcccgctg ccgcgatctt tccacagggc 461041
gaggctcgaa atgcctagcc aagtctttgc aatggccgct gactagcaga ccgcccccga 461101
aaagtcggcc gacaagaccg gaatttcggc ggatgtgacg gatgaggtca cgtccgatct 461161
cggaagagat tttacttttt tgcctgtggc ggatgcggag agacagatcc tgattggaga 461221
accaacgatg acaagtcatt tcgttacccg cgacggctcc acatggatgc cgcagtatct 461281
gacggccatt gacgccatga cgtgcattgg ttgcggccgc tgcttcaagg tctgctcgcg 461341
cgaggtcatg catctgcacg gcatcgacga atccggtgag atcctcgggg cctgcgatgg 461401
cgaggacgac gacttcgctg gcgagctcag tcgcacgatc atggttgtcg atcacgccgg 461461
ccgctgcatc ggctgcggag cctgcgcccg ggtatgcccg aagaactgcc agacccatgt 461521
agcggccgac gaaattgttg cttgatctga cgaacggact ccggaaaacg actttggccg 461581
ttataaatgc gatcatattc gagacgacag tccccaaaga gcccttgccg tcgcgcaagc 461641
tgacgaaaga cgtagacatc gccgaccgtc ggccccgtcc cgcagctagc agccgacgta

Figure 3 (Cont.)

461701
gaacaacgaa ctgcccagcc acctgaaagc cagagtccgc cgaacttgga atgagacaga 461761
attggcacaa tattgatttc ctcgcgtgat tcagggtgaa tccctgcctt ggagtcaaga 461821
ggcaattggc gcccgcgggc actcagagag gaccttcgaa tgccccgttg gcatcggtca 461881
gcaacggaat gcgtcagcag cctgagcgat cagcagttag gttacaaaag cactgctgct 461941
cgaagcgcac atgccgacgc aaattggtga agaaaccacg gagcatatag cccgctgcct 462001
ccggattgac agtagcatcc gccgtcgcca gccgacccaa cacttccgcc aattcctcgg 462061
cgaagcattc gtcttcgcaa tgctcatact tgagcagacc caaagtagtt aaaactgatg 462121
gatcgtcccc tagcttctcc tctgtccacg cgaaaacagc agcttcttct ctctcgtgaa 462181
gattccgtaa gtgcgggcca agcatctttc cggcgtgagc gcatatacta cggtcgactc 462241
cgtgcggaag gctgtttgca atggcctcga gacggtcaca gagagacagt tggtcctcgt 462301
gcgaacctgc caataaggcc agccgctcgg cggtggctgg agctaatgac cggtttgtgg 462361
ggggcgcaaa cgtcttgatc ctagcgatca tacactccag gccctttccg tgctttctct 462421
aaggtaatct tccgtgctca aggatgaggt aatgcgtggt gcggggcctt gacttgaatc 462481
aaggtctatc ggcaatagga ctaaataatc atctcattgt ctgatggatc gtacgcggcg

Figure 3 (Cont.)

462541
tttcccccca agcgctctgc tgttgtgaga tcgccatgag cacgtcggga gtcccagcta 462601
attgtgagac gctgatccgt tgtgcatgga cccacggcat gagcgcgtcg atgtctttgg 462661
cgagtggcgg ttggcgatgc cgatgaagaa attggtagac tgggttcaac accattcatc 462721
ttgcaaatcg gacccagcta ccattgcctt gatcatggcc ggcacagaga gcgcattgcg 462781
gcgcttgggt ttcttatcgg ctttttcgac gaagccctgc atgtcgcagg gagagccttg 462841
gcggacacga atatgcggcg ccgcatagac ccaggaacgc agcaataaca cgatcggcag 462901
gcgtgaacag gaagtatggc acccctatag tgccaatgac cgcccggaac catgtcgggc 462961
gggaccgagc gagctcgcct actcggcaga aggccagcct ctacggatcg ccgcctgtcg 463021
gttttggacg cggcggtcca cttttagccg ccaggctgtc gttgttcgac atacgacaat 463081
gttacaatgc cgacatagct agttcgatcc aggtacttga atttaaacgg gttttccgtg 463141
gcacgtatct tgctctgctg acgtgtcagc gtcgacgaga attgtgcgga gaatgtcgaa 463201
atgtcagaac cgttctttag gccggggtcg gggcccgcgc ccggccaccc tactgcagaa 463261
ccttggagaa gaaggaagag gtggtactcg ccaagcgatg gtcgagctgg cactgcacgg 463321
tcgcatttgc cacagcggtc gacgagccat gatggagtgt gttcgcgtat ctgtgcattt

gtcctatgta tggtcgcact gcaatttctg atgacctcag caatggcggc cgacgagagc 463441
ccgcttcgcg aagccgaggt tgcaaatttc atgctgggca acggcatgga ggtagtcgtc 463501
atacccgatc accgggcgcc gatcgtcacg cagatgatct ggtataaggt cggcaatgcc 463561
gacgagccac ccggcaaatc cggcattgct catttcctgg agcatctgat gttcaaggga 463621
acgaagaagc atccgtccgg agagtttagc gcaaagatcg cggagatcgg cggtgaggag 463681
aacgccttca cgggttccga ctacaccgcc taccatcaga cggtcacgcc agagtcgctc 463741
agaacaatga tggaattcga agctgaccgg atgcgccatc tcgttctcac cgatgcggtg 463801
atcgtacccg aacgcgatgt cattcttgaa gagcgacgct ggcgcgtcga gaacgatccg 463861
gagcagctac ttgaggagga gatgcaggcg accttgtatc agaaccaccc ttaccgcatc 463921
ccgacgattg gctggatgca tgaaatggaa cagcttaatc gcgaagacgc actaaagttc 463981
tatgaccgct actatgcccc caacaatgcc attctggtcg tggcaggcga cgtggacgcc 464041
ggcagggtgc ggcagctagc ggacgagact ttcgggaccc tgcctcgcgg tccggatctg 464101
ccggcgcggg tgaggccgca agagccggag cagaacacta aacggatcgt cgcgctcacc 464161
gacccgcgcg tcacggtgcc gagcttccaa aaatcctggg taacgacgtc ctacggaaca 464221
gccgagcagg gcgaagcgga agccctcgat atcctgtcgg agattctcgg cgggggaacg

Figure 3 (Cont.)

464281
cgcagccgga tctatcagga gctggtggtc aaacaggcaa tagcctcctc tggcggggcc 464341
tatttcaacg gaaggtcgct cgatccgtcg agcttcacgg tttttggctc gccgcgcggc 464401
gaggcgaaga ttgaggaggt ggaggatgcg atagacgctg aaattcggaa gatcatcgag 464461
ttcggcatta ccgacgtcga gctcgagaag gccaaaaacc gcttcgtgcg ctcgataatc 464521
ttcgcgcgcg acagccagtc gggaatggcc ggcatttatg gggcggcgct tgcgacaggc 464581
gatactgcac acgacgtaga ggcgtggcca cttaggatcc gcgccgtaaa ggcggcagag 464641
gtgcaagcgg ctgccaggaa atacctcagt cccgaccggt ccgtagcggg gtatctgctg 464701
ccccgcgaaa gcgctacctc aggagataaa agccgatgat atcgttcagc cgactgcgca 464761
tcggggccaa gccctcactc gtcgtggcat gcatattgct gggccttgcc gcgtgtccag 464821
cgcttgcggg catggccata gaggaggtcg agacatcgag cgggataaag gcgtggctgg 464881
tgcaggacta ttcgctaccg atcgtcacca cccgcttcgc atttcggggc ggcaggacgc 464941
aggatccatc tgggaaggaa ggcattgtga atctgatcac agagctgttg gacgaagggg 465001
ccggtaatct tgacagcgat gcctttcagg agcggctgga cgatgctggc gccgagatgc 465061
tctttgaggc ggggcccgat gcagtctacg gcaatatgcg ggtgcttgcg gagcgaaagg

Figure 3 (Cont.)

465121
atgaggcttt ccaacttctc cggctggcaa tcgagcagcc gcgcttcgac caacagccgg 465181
tggaccgcct tcgtgcccaa atcgtctcca gcatcctggc aagagccaag gatccggaga 465241
cggccgcaca gttcgcatgg atgagggcga tctatggtga tcatccgtat tcgcgtcggg 465301
aggagggcac cgtgcaaaca cttgccgctg tcacgacctc cgatctgaag gcggttcatg 465361
agcggatttt cgcgcgcggc aaccttacca ttgccgtggt gggagcgatc gatcccggca 465421
cactcaagcg tgatctggat cgaatattcg gcggattgcc tgctggcccc tccctaacgc 465481
cggtcgttga cgcagtgcct aagctggggc gcgccattcg cgtcgcgtat gacttacctc 465541
aggcccaact gagcctagct tacccgggaa tcccccgaaa ggacccgcag ttctttgcag 465601
ccaatctcat gaaccaaatc cttggcggag gcgcgttcac atccaggctc tggaatgagg 465661
tgcgcgagaa gcggggcctc gcttacggca tttactcaac cttggagaac atcgaccatg 465721
cttcggcgct cgtcatcggc accggaaccc gcccggatcg ggccgcagag acgctctccc 465781
tcatccaagc cgaggtcagg cgaatgtcag aggagggcgt cagtgaggac gagctcactg 465841
cggcaaagaa aaagctcatc ggcggttatg cgatcgaaaa tctgaactca tctagtgcgg 465901
tcgcccaaac attggtccaa atccaactcg aagatcgcgg catcgagtac gtcgagcgcc

gcaaacaact gatccaggcc gtcaccgtgg aggacgtacg ggcagtcgcg aaacggctgc 466021
tctccgccga ccccaccgta atgactgttg gaccgtccct caagggaacg aaccgatgac 466081
cgtccaaagg aaagctaggc tggcagcgtc cggccgacct tctccaacgc cccggcgcgg 466141
cactaccttg ggaggggggt agtcaagatc acctctcgcg gtcaccagat gttcagttcc 466201
aggctctatg cgactcctga agcagcaagg gagtgcatcg cagcctccct ccgcccgacg 466261
gcaggagaga atgtggtgtc tcggcgaaaa caggcgaatg ctctctagca cgactgctcc 466321
tgcgatgctg gtgacctgct ggcaacgaga ctgcttgacc ctgcagcagc ggttctcgcg 466381
tcactcacga aagcgcatca gcaccaccgc taaggcttca cacttgaagc ataatccgaa 466441
tgtgcttagg gtggccgccg aagactccag atgtctcaat tgagtttctg actttcagtt 466501
gaggtgtgtt aaaggagtgt aggtgcggga ggtggagctc atatcatatc tcccgaagaa 466561
ctaagatagc cgaaattgag gagacgaatg tgctgagtac taactctgaa caaacaagac 466621
gtaagccaaa cgctgtggat gcccatgtcg gtcaacgaat ccgccagagg cgtgagtggc 466681
agaacatgtc ccaaacgact ctcggcgaag ctatcggggt gacgtttcaa caggttcaaa 466741
aatacgaaaa gggcgtgaac cgcgtcggtg cgggtcggct tcagcagatt tcgaaggctc 466801
tgaaagtgga gccttcctac ttctttgagg atacgcttaa taaaatccgg tcggaggagc

Figure 3 (Cont.)

466861
ggtccgcttc aaatcagatt aacatcccac ccgaagtcgt tgaattcgtt gtaagcaagg 466921
aagggatcga gctcatcagg gccttttctc gcgtgggcga ctatcgtgtg cgccgccgaa 466981
tcgtgatgct ggtcaagtct ttgggcgcac acgagcggtg atgtatggat tgggccgctt 467041
ctgtgtggag acagagtgtc tctataaagt cggacaagca ccaccgcact gggaaatgag 467101
tcaccagtct gtccgatact ctcgtacggc cctttaccct ttaaacgtcc tgaaatacca 467161
aggcgatact cgccgatcaa ttctccgaat cttggcgggc tgagcggcgc gccggtcctt 467221
cgggatactg cggcgaccat cgactgcgag cttgaggatc tcatagaacg acacagccat 467281
gcgattatgc tcggccgttt tgtcgacatt tgcaagggca acggtcgttc attggtctat 467341
cgtggcggcc gatatttgca attgccgggt agcgttatag gcaaaatcgc tccgggactc 467401
accgcactga aaagctattg aacgtggttt ttgcgcaagc ctgtctatga tctcaatcaa 467461
ttcatctgta gttcattcgt gctagcttga gcgcagcctt agttgccgac cacgatccga 467521
cttgaagcga gcgatgcttt ctacaccggt ttcaccggtc agagcggaaa agaagagtcc 467581
agccggcccc gatttcctat tctgagacct cagaacggag atcgagatct tttcatttgt 467641
agcctgccgc ggaatgggcg agcgctgacc tgagttctca gggtcagcta ggcaagcgcc

Figure 3 (Cont.)

467701
ggaatacgac tggacgtgat caatcgacgt cagaagctat gggatgttgg agaagaaatg 467761
cgtaggttgc ttactccctg gcgcggtgtc gctgcaggct ttctgttgaa cgggatcctc 467821
ctcgggacct gggcttctcg cgttcccgcc gtgatgggtc actttcacgt tgccaaagcg 467881
agctttgggg ttttgctgtt gcttttaggg ttgggcgcat taatttcgtt ccccattacc 467941
ggaaggctgt ccgatagctt gggtgcagtg cgggtcgccc gaatgatcgc gatcccgttc 468001
ctggtttcga ttgccgctct agggcttgcg cccacaatac cgctgctggc gatcgcccta 468061
tttctctttg gcatgtgtca tggctcgatg gacgtagcgg tgaatagttg ggcgagcgaa 468121
gtggagaaac acatgggacg gccagtgatg tcgtcgtttc acgccatgtg gagtgtgggg 468181
gccgttctcg gcgcagcagg cggttacatt gctacagtct ttcagacccc agtgtacgtc 468241
cattttcttg ttacggccgt gacgatcggc gggttgctcg gacccttcct tctgctcgat 468301
tggcaatcaa ccatccgaac gcatgaaagt ggtgcagtgg gattggtgtt acctaacagt 468361
ggccttttc ttgtggggct cattgctctc gcctctggac taggagaggg tacagctctc 468421
gactggagtg ctgtatattt gcatgatgta gtcgggaccg aagaatcgga cgccgccttg 468481
gggtacatgg gcttttctgc ggccatggtg atgatgaggc ttaaggcgga ttctctggtt

acgcgatggg gatcagccac tgttgcacgc ataagcggtt tctcggctgt ctttggcatt 468601
ttgttgatcg tcctcggtga aaccttgccg ttagtcgtgg cgggcttcgt gctgatgggg 468661
gtcggctatg cggccgtcct accattggct ttcagtcggg cagcggccga tcttgtagtg 468721
ccggcgggga aagccatcgc gtccgttgca atcttcgcat atggcgcaat gacgttggga 468781
ccctttgcaa ttggactcct cgccgaggca gccactatgc gtttatgctt ctttatcgtc 468841
ggactatttg cagccttggt ggcagtattg gctccagtgc tcaagcaata gaacaaatca 468901
ccccctgctt tatcgcacct tgagagattt tagcgttttg tccatgagag cgacgaatac 468961
tccgcctttt gctgaccgag gccgcgagta ttcttcatcg gcaggcgcgg aacggaacgg 469021
ttggagatca cgccgacgcc atttttgaag gcatgggtga accaggcatg aaatggatcg 469081
aggtgaccgg ccgaggccag cggcggtatc ggactgacga agatgagtaa tcaaaagtcg 469141
ataaagcgtt aattcatatc atcaatggct gcgatgaaaa caaatgattt tactgaatag 469201
atgcgggcga aatagaagaa cgctcatcaa gttggagtca gtgaatgtgc ggcactgtta 469261
gcccaactcg cgttgactgt cggacaaagc gactatcctc taggaattga atggagagaa 469321
ctatgtctga tgcaaagctg caacgcgtac tttcgtctct tacggaagtg tacagacagc 469381
taaattctct gccgtccagt cagccatctg acgccggcta tgtcaaactc gatacaaacg

Figure 3 (Cont.)

469441
agaatccatt tgcgttgcca aaagcggtaa tgcagagcgc agttgctgct ctcgagcggc 469501
agtatttata tccagaggat gacaacatca gtttgcggga agccgccgct gcgtcctatg 469561
atctttccgc ggatcaggtg atcgccggta acggttcgtc cgaacttctt tcgctcatat 469621
ataaagcatt ccttggtccg ggtgacagtg tcgcgatgct gtcgcccggc tttgcataca 469681
accgcaagct cgcccagttg caaggtgctc gattacttga aatcaaatgg ggcgagtcgt 469741
ccttgttgcc gatacacgaa ttgctcttcg gtcctgcaaa gcaggcaaag ttcatcctgc 469801
tggctaatcc gaacaacccg acaggaacat ttgtcccgat tgctgatatt gaaagcctcg 469861
tcgcactatc tgaccagttg gtggtactcg atgaggccta cgtggacttc gctcccgaca 469921
gcgctctgcg tctcgttaac cgctattcga atcttctgct cttaagaacg ttttcgaaga 469981
gctatgcggc ggccggcatt cgcgtcggct tcggcttcgg tcatcctgag gtgataggga 470041
ggctgcgcaa tatccagaac atgttcaata tgaatgtgat cggccatgcg gttggcgtca 470101
gcatcctggc ccaccgcgcc acctataatg agaaccaccg ccatatcagg catgagagag 470161
agcgggtgag ggtggcgctg tcgcgacttg ggttctctgt aacgccctcc catgcaaact 470221
ttttgctggc gcgggtgcct gcaggacgag acggcgtttg gtggcacgcc tgcttgaaac

Figure 3 (Cont.)

470281
ggaaaaagat actcgtggcc gttcttcccg atgaaggtct ggaagattgc attcgcgtca 470341
gcatcgggac gaaaccacaa atggatgcgt ttcttgcggc tgtcgaggac atttcgggag 470401
ctcagcaatc tcgatgatgg gaccgtatag cagcttcagg ctcggctctt ttgcacgtgg 470461
gaaaagacag tggcgacagg aaagagagcg acaaccggaa gactggtctc ccacagcgct 470521
aactacgcca cgcccgtgag gaagctgagt tcatagcctg gcgcctgcat gtgtctaaag 470581
gcgtgctcca caacacaagg tcgctgggac ggaaacatct gccggtaggt gcactgaaaa 470641
actgttgagc aatagccgag cacgcaagga tgtggcctgt cggcggctta acgatttggc 470701
ttccgccacc gttaggcaag ggcaggctca ccgtgaatag cgatgttcgg ccaaataaag 470761
cccccaaggt cttatttcgc tcgaattgaa gtccggggct accagggtta agtgagacgt 470821
taaatgagaa aaatccttcc atcaaagcta gctttcggca tattcgacca tttagacgag 470881
gacggtaacg ccatggcacg gcaatacgca gaccgcctca cgctagcgga agcatgtgat 470941
cgtctcggct tttacgctta ccacctagcg gagcaccatt tttcgccgca tgggagaagc 471001
ccatcgccga atctgttcct atcgagcgtc gcgcagcgca cccgtcaact tcgtcttggc 471061
ccgcttgtca tgctgcttag cctttctcat ccgctgcgtg cgtttgagga gatctgcatg

cttgaccatt tgagcggcgg tagggccgag ttgggcatag ggcgcggctc tcttccgata 471181
gagctaggtt acttcgggat cgatccggac gcggtggctg gacgctattt cgaagccagc 471241
gaaatcctga tggaggcgat gaggggcggc aatctttcct accgcggcga ccactttgaa 471301
ctaaacaatg tccccttgat cctgaggcct catcaacgcc cgcacccacc gacttggatc 471361
gccaccaacc gacctgagtc tgcacgctgg gccgctacaa acggcgcaaa tgtcgcatgt 471421
gtgggacccg cctcgcttgt tcgcaggatt actgatgcct tccgttccga ggaaggactc 471481
agctctgacg cgaactgcaa cgcgtcattt ctcggactgc tccgcatgat tgtcgtcggg 471541
cactctgcag aacatgcata ctcgcttgcg gctcctgcct tccaacgatg gctgaataat 471601
ttcaaattcc tgtacgacct ccatgcaatt ccagttccgc caaatctgcc cctgaccttc 471661
gatgcagcaa tcgaaagtga attgtgcgta gtgggaacgg cggctgttgt gcgacggact 471721
ctgcttgatc agttggaaga ggcgggcgcc aactatctcc tttgtcaggt cgcgtttgga 471781
gatttgcctt tggatgcttc gctgtatacc gcaatgacca ttcaatcgga actaatggat 471841
cgagttggct gagtgccatg gcgcctgacg aagtcaggcg tgtgtaaaag tgacggcttc 471901
ctgtcgtatc aggcgcaact ccaattcggc ccaaaaatca acaatgggct ggtcggcgct 471961
aagtacatct gactcgaagg tgttttatcg ggtagcgtgg cttctgggaa gaggtaagat

Figure 3 (Cont.)

472021
ggccgagatc gacgcaatat tgataacaga cgtaaacgga ataggaacga ccgcggatga 472081
tcaactagca tttgtcagtt tgattgctga tcaaggggaa actaccacag tagcattcgg 472141
tccagaaatt ggcagcagaa tagctgcttc gttcatggcc gcatgcggac agctccaaca 472201
tcaaatcgct acgagaacgg ggaaggagga aagaaagttc aagccctttg ctgcagccgg 472261
attcagcgtc agagctggtc tggccgccga tggctccaat tcgggaatgt tatcaatttc 472321
aaccgtagcg ggcgctgagg ttcactttat agcaacggaa cgttctcttc gagaactcga 472381
aaaccaatta acgttattgc tcgaacaatt gcggttacgt tcgcgaccga attaatgcga 472441
ttgtagcggt aacaaagctc ttatgactat catggctagc aaggcctggc agtaatggat 472501
atcacccatt tgggtagaat tcacgcgggc aattcgaacg acaatcattt tgggacgagc 472561
ggcgctggct ggtcgtccat gttgagtgca tattttccca aacggcgaat atgcccggtg 472621
ttgggactga gagtggcggc aagcttcggc gtgaagcccg cctgaccacc tgccgaaggc 472681
atgtcgcttg ctaccgtaat accaacttcg ctcgggatct gatcgagcgg gaagtctccg 472741
gcgccgcatc ccaatcgtgc gctatgcgga tctgtcaatc aacagcgcgt cgccctgccg 472801
ccgccacggc ctttgccacc agccgcattg aggctggtgg cgtgagccga ctgccataat

Figure 3 (Cont.)

472861
tgtcgtgccg ggcgcaactc caccgctacg ttgcctggat gcgcgacgaa cgcgttcgct 472921
gtttcgtagt ggcggatcgg tctcctcctt gtccatcgct cgccagcggg taactgctca 472981
tcgtctctct tttcggcacc cccgcacccg caggcgatag tgacagcgcc gataggcttg 473041
cacctgcgtg cgaccactct tccatctcct caatagcctc catccaaata agcgatttta 473101
catatctgct gagatttccc attagaatag cgtggcgttt tgggttgaat tcaattggga 473161
caaggatagc agtagacgcg gagccttctc cacacacggc tgccccatcg agtggtatgg 473221
gctgtcggca aactgctccg gtccgaagcc gcactctccc gcgccctgct tgaaaccgcc 473281
gagcccccgg ttcgcccgca ggggccgtgt caaccgtata gtcgctctaa agaggaccac 473341
ctgtgaaaca tatcgttgca accttattcg ggatactgtt tgctacagct gccaatgccg 473401
ccggcgatag tcatgtactg gcgagctttc ccgagcttga acgcgcgctg actaccggca 473461
aaccggtgac tgtgacggtc gatttaggca tgtgcactcc ggcgacttcc gatacaccgt 473521
cgaccaagac gcgtggaggc gttagcatag acggctatag gatcacatct gacggcaccc 473581
tcgcttttgc agatcagcat tttaccatag atcgtgacgg taagccggtt atccagtttc 473641
ttcgttaccg gatccggccg gacggtggcg ccgaattcac catggtcgtc ttcaatgtgc

ccagttacga gcgaaaagga acgagccggg tctataagtg ctcaattggt cacggattga 473761
gcttcttctc ttcacagtga tctggcatgt tgcagcacga tcgcgcgggt tcgggtggcg 473821
gatcgtcccg gatcggcggc tgaaggtttc cctggggcac ccgcccgtgc catttgcagt 473881
ggtcccgata ggtaaaggaa cccgcctgcc gctatccttg agcttcttca gcggtctgtt 473941
atgccgtcgc tggtctgcca agcatagcgg tcatcgaggt cctcttcgat cacgccggcc 474001
gcgtataact gatcgagcag gtcggcgaca gcaagtacgc ttattccatc cgtcgaggcc 474061
cgcataacca actccgaggc tgtaaagttg ccgcacgcga ttagatggcc aaccgagatc 474121
ggagcgtagt cgagcacccg gtgttccatg cttcgcgagc ggagatggaa gcagcggtct 474181
cccgctgtgt actccaggtc cctgcgaaag cggatcggca ggtcgggggc tgggctctcg 474241
agcatatgtt gatcaatcat gctcttgagc ccgtcccgga actcgtcagg cgtcctgaat 474301
gaccgttgac ccactatgcg atacccgagg ggccagcgtc cgctacccgg taccggcgtc 474361
actagttgca aacgtctctg cggcatattt acgaggaagc cggaaacaca ggcgatcgtc 474421
gtgtgatttc gctccggaaa ggcgattgcc tcttgcctcg cactgagttt ctccttccgc 474481
ttgcgcgccc gccccgtgaa agcctttgcg gtcggagcgt ccttgccctg catgatgagt 474541
tcgacccctg tcagttcttc aggcgaaaac gccctgtgga tctgattgag atgtgccgtg

Figure 3 (Cont.)

474601
ctgagcacag agaagcgatt catcgtagtg ccataaagat tgaagaggcc gagcacgcgc 474661
ctggtgagtg cctcatcctt gagcggggcg gccgtcgttg tttgcggcaa tgcgcccgtg 474721
atctgatagt agtcgaagag aaagcggtcg tactgcgggt tgtccattgg ctctgtggcc 474781
cagtagcaga atccagtacg agctgccggg ccaaacacct cgctcgcgac accaaccacg 474841
ccgcgccaaa gctctgcatg ctgtttgcta tactcgtaat agcctttgaa cggagcggcc 474901
gagaggccgc agaaccagca accgacggtg caccettcgc tcagctcgaa agcgatgatg 474961
gggtgcgtga tcgacggcgc tgatccgccc aattcgtcat tacaacgccg aatttggcgc 475021
tcgcgccagg catgaaagcg agggttggtc attgacatat cgccatggtc gcgcaggagg 475081
tcgcgatggc gcaacatgtc gcgcatgtac tcgtcccaca ttatcgacag cggccatggg 475141
gcagactccg gcttgtagcg gtaagtaaga tgatcatcgc gccagagcgg cagtatctcc 475201
agtgggtcaa cttcaatgcc atagcgctct gttaccgcgc gaggggcgtc gacgctctcc 475261
gaaaccgcgg tgcggaactt tatgtcacca gccagccgtt ccatgaaacg cttgatgtgc 475321
gacaaggtgc gccgttgctc cggcgtgcgc cggttaaaga tctgtcgcca atattcgcct 475381
ttataaaggt gagcccttga agccgtttct tgtaggccag atcgcatgtc tcgttcccga

Figure 3 (Cont.)

```
475441
tgatatttgc tgtcatgctc tcttggcacc gatcgtccaa gccaatgcgc tccggtaaaa

475501
aatcagcttg aaacatgaac aacaattaca acaagttgaa cgaccgcggc gacggcggcg

475561
cctttttcag caatatgcaa cggccgcgtg agcccatccg taacgggact atccaaagca

475621
ctagattgta ctaagcgcgg caaggccgga acgcgcgagc cacgcttgct gttcgccatc

475681
gcttcgagct tcttgccagt agacttccgt cggctgtcca atcggatgta gttttgaact

475741
tcgtcaagcg tgatgttgta gccgagactc tttccggccg ctacgatcgg tgcaagaccc

475801
gtggcacttg gcttgaggtt tgcaggcagc ctgcctttgt ctaaatcgtt gacgaatcgc

475861
tctacgtcag ctcgcggcat agctaattcc tttgctcata gttgccaatt gcaggcgtgg

475921
atgatgccgt gaacgagcaa gcgccgtgcc aacctaaaaa tgtcgtcatt ttgtgcattt

475981
tcagagtgca tgcattgtca acttaccgac ctttagtccc gaaccggcca attggccgct

476041
ccgaaatgta gacatccgca aaattcttca ctaaggcagg ctctcttttt tgccagctca

476101
gttgcggatt ccgccagtcg gttcattcag tgaaacatcg ggatacgctc aaaagcgtga

476161
cgacggcgta gcggcgtcag agagaagcgt cgacgaatcg tgcggagtgt gggggtcaca

476221
aacggccggc atagcaggtc gacgaccccc acggcggtgg ggagatcaga gctgtatgcg

```

tatcatccgg acatgaccca ggctcatgca accctgaccg cgaccagcgc tgaagcgggc 476341
cgacggcatc gggttggcac tttaggcacc gacgcattag caatggacgc gcatctgcgc 476401
cgactgggta tcggcgatgt gcattatgat ctgtctaggt ttcgatcgcc ttggtcttcc 476461
gacccttcca tgcaccacgt gccaacgagt tttattacag cctgctaaac taaccgcttc 476521
attccaacgc gtccggagcc gcgactactt tgtcggactg atgacatcgc tgtgtcgcaa 476581
ccccgccgca gtcactgatt tcggatggct gcaagagttc ttccaatggt acgaagactt 476641
ggattggcgc agcagcttta gtcggatcgc gatcctcaag caccttgaaa acacgatgtt 476701
tgagtggcga cgaagttgca aagtccctgt aagcgcgctc gagtgcggcg cgcgcacggg 476761
tggcggccgt gcctgtgggg agatcggaaa agtcctccgc gaccagatac tgacccatgc 476821
gcttcattat gtggagccgt gatgtgttta gcacctttgg gtcataggtg acgccgaggg 476881
catcgaagaa ctcctcggcg gccgacaaat ccttcagcca ggtgagaatg tcagtgccat 476941
caggggcaaa ggtcgcatca tcataagaca ttgcattctc ctactggccg cggaatagct 477001
gctttcgttc caacacatgg tcccggccct gcaccctatg atgaccctgg gaagagctgt 477061
gatcgagacg ccatcagtga cggctattcg gacatgccca agcgctcaaa caatcgtatg 477121
tgccggcaga gcgtctaccc ggcaaatact ggacgagatt cacgcagttt tttcacaact

Figure 3 (Cont.)

```
477181
gcgggtatca cccgcaacac ccgatctata tcctcttcac agttatagcc tgacaacgag

477241
aagcggactg ctccgaccgc ctgcctgtgg ggagtaccca tggcttttag cacatggctc

477301
gtcgataaag aacgagaggt acaggcggat ccggaggagc aggcgatgcc atggcgattg

477361
agcagaaact gcatggcttc accaccgacg ccttcaaagg caatgctcgt tgtgttgggc

477421
aaccgcgtca ccggatcacc cattacgaag acttggggga cacgctcgag aagtcctttc

477481
tccaatcgat cgcggaatga tcttattatc gcattgtcct tgtccataca atccaacgcg

477541
agttctgccg ccttgcccag acctactatc ccgggcgtgt tctccgtgcc cgcgcgccgg

477601
tcgcgctcct ggtggccacc cttgatgagt gcgtgaaagg gtaccccgcg ctttatgtag

477661
agtgccccga cgcccttcgg gccatggaac ttgtgcgcgg aaagcgacag catgtcgatc

477721
gccgttgatt tcaagtcaat cggtagcttg ccgattgctt gcaccgcatc ggtgtggaaa

477781
attgcgccga cttttttggc catctcagct agctttacca caggaaagat cgttcccgtc

477841
tcgttgttgg cccacatgat cgaaacgatt gctacacggt gtgtaagggc gtcctgataa

477901
gcgtcaaggt caagtcggcc ctggtgatcc actgggacct tgtgcacctt ggtgccgcgt

477961
gtcttctcca gatgggtgca gagcgtcagc accgcaggat gctcgaccgc cgaagttacg
```

Figure 3 (Cont.)

478021
atctcagtgc gctcaggcat agcctcgagc cccgaaagga tcgccgcatt gttgctttcg 478081
gtcccgcccg aggtaaaggt gatctctggg tcgaactttg caccgatcag tgcttgcaac 478141
tgcctgcgcg ctacgttaat cgctgccccg gcagtagcac cagcgtcatg catcgaggaa 478201
gcgttgccaa acacatctgc aaagaatggc agcatcgcct ggagaacttc cgcatcgacg 478261
cgcgtcgttg cgttgttgtc gagatagata ggcctcaaga taattctcca gctaccgaaa 478321
cgacgaaagg tttacaaatg gcgatcgtgg cattgtagaa gtgctttttg atccagcatt 478381
actgttctcc cgtgcgtggc gatcagccga acgatttgcc ccaggctcac ctctcccgcg 478441
cgttgaaacg ttgaagacta acccgggcga atccaccctt gggatgacgt cccggccagg 478501
ccggccacat ggggttgggg gtccgagtca acaaatatgt tgatcccatc cttctcgata 478561
acagtgtcgc cctcgcgcga ctcagtctct aatgcaaaat ggtatatgca cagccgtccg 478621
cttgaaccgt catatgcata agccatcggt cggttcagaa tcgcgggaag gagggagctt 478681
cactgcacta acggctcttc cgttaagacc tatcatggat cgtttctcct ggttcgaaaa 478741
ggcctttgca aatcggtcaa gcacaaacta tgccaacgaa aaaaacggtt ttgaaacaac 478801
accgaaactc aaacatcggt gtgacatttg tccgacaatg tcggaaatcg gacattgtcg

aattagccca caccaaagag cgcctctgtg ccgcaaacaa gatgcaatgt gatgacttcg 478921
gcggcgcagc tcttcgaaag cttgatggca gacggaggat gccagccata gcggcgattg 478981
ctggcacttg cctcactcta caatggcggc ccccgttcgg aggcagcgcc attcggcagc 479041
gagatgctgc agtgttgggt ccccaacgaa cggtgcaccg cggcgaccga gcgacactga 479101
atgacgctca gcgcccgggg ctggcaaagg acgtcgaaag caggctatcc tttaaattca 479161
ctggcggcgc agatttggtc cagaagttgc gcatttcgga tgaggcgacg gtcgggcgtg 479221
aactggtgac gcccggcttc gccagagctc ccgcaaatgc aactacagcg aacgcccgcg 479281
ggcaaatgac aggcagcgct cttcgaccac cacacctcgg ggaagcccag tccgtatttc 479341
ggcagctctt tcggccgggc cagcgcgtcc caataggcga tttgggcggc cagcttgtaa 479401
tagagcggaa tgacgtaatt atgggcgagc aggacgcgat cgagtgcctt cgttgcggca 479461
accagcgttt cgcgatcctt tgcgaagatc acgcgctcaa tcaaggcgtc gacgccaggg 479521
tcggagatgc cggcataatt cctggagccc tggcgtgtgg cggctgccga tccccagtag 479581
tccgcctgtt cgtttccggg gctcaaggac tgaccccaaa cttcccaggt cacatcgtag 479641
tcgaaggcac gcttgcgatt ggtatattgc gatgggtcca ccgtgcgcac gcgcgcttcg 479701
ataccgatcc gcttaaggtt ctgcgcatag ggcaaggcga cgcgctcgaa tgacgggctg

Figure 3 (Cont.)

479761
ctcaacatga tctcgaagga gaacggcttg cccgtctcag tattcaccat ccggttaccg 479821
ttgagctcga accccgcctt gttcaggagc tcgatcgcct tgcgcaggtt ttcgcgcgcc 479881
ttttgcggcg tgccgccgac cgggttgcta taaggggtgg tgaacacttc gggcggcacg 479941
aggtccttga cctcgttgag gttcttcagt tccttgcctt ccggcagacc ggaggaggcg 480001
agttctgtgg cgaagaagaa gctgttcacg cgctgatact gattgtagaa gatggtccgg 480061
ttcagttctt cgaagtcgag cgcatagttc aatgcctggc gcaccctctc gtcgtcgaag 480121
ggcttgcggc gcatgttcgg caccatcgcc tgcatcacgg ccgttgcccg gaaggggttg 480181
ggaatttcct cgcgtttaac gcggccatcc ttcaccgccg gaaaatcgaa ggccgtagcc 480241
cagcgcatcg cctggttctc ccgccaataa tcggtgttgc cggagcggaa ggcctcgaac 480301
tcgacgtcgc gatcgccaaa aaaggaatag gtgatcgaat cgaaattgtt ctgcccgaca 480361
ttgacgttga gcgcgacgcc ccagtaatcg ggccggcgct cataacgaat ggtcccgccg 480421
ggggcgaacg aagcgatccg gtagggacct gaccccatca ccggttcaag cgtcgttcgc 480481
gaaatgtcgc gcggcttgcc gtccggtcca gtgccctccc accagtgctt cggcacaatc 480541
cggatctgcc cgaggatatg aggaagttcg tgattgtttt tgtcgtcgaa gtgaaaggtg

Figure 3 (Cont.)

480601
acgtcccgat cccctgtctt ttccgccttc acgacatgcc gatagtagct ctgatagagc 480661
gggttcagtt ccttcgcctt gtcgaagctg aagacgacgt cttccggcgt caccggcttg 480721
ccgtcggccc atttcgcttc ctgcctcagc cggaacgtgg ccgaggagat gtcgtcgggg 480781
aaggaaacgc cttcggccag aagcccgtag gccgtcgaaa tctcgtcctc tgacggtttc 480841
atgagcgtgt cgaagacgaa atccaggccg acggccgttt cgcccttcac cagcagggga 480901
ttgaacgtgt cgaaggtgcc tgtctgtgaa agcctgagat ctccgccctt aggtgcctcg 480961
ggattcacat agtcgaactt tttgaagccg ggcggatatt tgagatcatc gacgagcgac 481021
agtccgtagt gccagaccgg ctgctcttga gcctccgcag ccggcaccag tagtaaggac 481081
atggccatga acgcggtcgc aaacttcagt cttccaatga cgccgatgtc cagcatctcg 481141
tcctttctcc ttgtttttat ccattcgccg ccacggtgtt tgtggggcgg ctccaagtcg 481201
ttgcaggatc ggcatgtcag tggccgatcg tccctagata tgggcaattc acactcctca 481261
aaaattgatt ttctaaattc tgttcatagc gtctatggat atgcggagct ttgtgcctgg 481321
tagggtcgcg gcctgtgtcg ctgtacccgt tgtcactttt tctggcggcg gcgatgacgt 481381
ggatgtcgac cagtgtcgca aagtcttcct tcgtcgctga caagcgtcga cgggataacc

agtatcagga aaccggtcat caactgttct tgcgcctttt ccgcacagcc ggcgaccgcc 481501
tcggcaatga gcgaggccgg atcgataagc actgcccgca cccgactgca tcacattggt 481561
gaccgcgagg tggacggcaa gtaccaaagt cgagaaggtc aggtatcaaa ctcgccttgc 481621
cggcgatggg accaaccttg gcgagaccgg ttatgcctgc gatctccgtc gcgaccttca 481681
ggaagatcac cggtgcaatg atcattccaa gctttccgat gtccggatag aaatatccaa 481741
acaggatgcc cgcgatcgct gccagaacct gggcatagag atggcgatat aagggtggct 481801
tggcgcgggt ctccgcggaa tgctcaatgg tcatcaggag atcctccata tggggcgcgc 481861
ccggtcgcct gccaagccga ttctccgaaa accgacagcg gcgactgtca tgtgaagctg 481921
atgagcaatg accgtgccag ttgccgttaa accgcagatc ctgacgcccg aggtgcttac 481981
tgttctcgac ccgaccagcc ccgccatccc ggtaaccggc cacggcgaca tactgatggt 482041
agtgcaggcg attaggacga cgcctctgac attatcgcca agctcttcgc cgccgacgtg 482101
atccacgaat ttgagtgcgc gaacaccatc ggtctggcac gacgggactg ccacctcacc 482161
gccttctgtc cataattctc acctttgtct caaggcaaac cttggccggc aagaaatgtt 482221
atttgcctcc atcaaatgac cgccgagaca tcttaatcgg cctccagcca aagtccgcag 482281
ccgcagcatc gattatcgat aaagacccgg gtggaggata gcgagatgac agatttttgg

Figure 3 (Cont.)

482341
cgccaccgac agaactggca caaatcttga acctgctcat tgcgaggcgg cggagctgct 482401
cattgcggca acaatcctat gcctcgactg cgccacgtat gaagatttca caatactatt 482461
caattgagtt cttgcgacaa atgggcgttg acgatgtgca agatggtcgc cagagccgcc 482521
gtaacgagag gaaagcgaaa tgtccaggac cgcagaaaag cccttcgaaa ctgtcgaaaa 482581
ctcgatcgtc ggtcaatcca cggcaatcaa taggggcgag caattgacgc atgctattga 482641
gttacaggag ctggccggat ccgtcttcaa gtcaacaatg atggtgggat ttgaactgtc 482701
gctgaacact ttcgctgcag tccaagccaa caccttcgct aatttgcacc atcttagcga 482761
gtttctcggg gcaaaatcgc cgtcccaagt tttcgaccta cagtgttcct tcctgcgcaa 482821
gcgtatagac atgggtgtcg agcaggtcaa agaatcccag gcgctcagca ccaaggcttt 482881
gattgatatg tcgaagccaa tcaaggaatt ctttgaaaag gctatagcag acctcaagac 482941
ggcctgatcg tcagcgatcc ccgccgtggc aggccgtgac ccgccacggc tttgcgctca 483001
gtagcctgga gtaccattcg atgatttccg ccgatttgtc ggattgatga catcggcttg 483061
tgttataggt gggggaaat cctggacgct atctacggct tctttcgccc tcctgcagga 483121
aggcggcacc tccccattgc gcattcaggg atcacatcgg ccccaaggtt tctgctccgg

Figure 3 (Cont.)

483181
tctcttgtgc gcaccgcagc gcaggtcctt gcgcacaagt agtcacgttg atcttcattc 483241
agctccctcg acgtctcgaa gacccaaccg cgcaacatac accggatcac gaatggacgt 483301
cgcgtaggcc gcggctcacg aaaggcaggg atgttgaact gggacgactt ctggcctcgc 483361
ctgacgcgtc ctaataggga ccacaccgtc agcgccggcc gaatgacacg tggcaccgcg 483421
acctgcacgg cgcctgatct gcaaacgaag cgactatcaa gttcgcaaca tctatcctgg 483481
ccgcccagcg cggctgtcat gaatcgtggg acactctgca agccggcttc agcacagcct 483541
ggttcgccga gcaccacttc gacaactaca gcggtccgtc gcctttgtcg atcgtgaccc 483601
actgcgccgg tttgactacg accattggcg cgtcggacgc tttcgacaat tgtttgtgaa 483661
attgtcggct ccgcgacaca ggcttgcttc tgggtcggct acttctccta atctaagtag 483721
ctgtaaaaga aggtaaacca gcttctgctg ggctcaccct cctcgacttg gcacggcttt 483781
tgaagccttc cttgtgcagg cggcttgaag ctgccgctgt attcgtgttg cgggcaaccg 483841
cgatggtttc gaacaacgaa ggaaagcaac atggcaggtc tgcgtcaaat cgcgttttac 483901
ggcaagggcg gtatcggcaa gtcgaccacc tcgcagaaca cgctcgccgc ccttgtcgac 483961
ctcgggcaga agatcctcat cgtcggctgc gatcccaagg ccgactccac ccggctcatc

ctcaacgcga aggcgcagga cacggtcctg catctggcgg caaaggaggg atcggtggaa 484081
gacctcgagg tcgaggacgt gctcaaggtc ggctacaagg gcatcaaatg cgtcgagtcc 484141
ggcggccccg aaccgggtgt cggctgcgcc ggccgcggcg tcatcacctc gatcaacttc 484201
ctggaggaaa atggcgccta tgacgatgtc gactacgtct cctacgacgt gctgggcgac 484261
gtggtgtgcg gcggcttcgc gatgccgatc cgcgagaaca aggcgcagga aatctacatc 484321
gtcatgtccg gcgagatgat ggcgctctat gccgccaaca acatcgccaa ggggatcctc 484381
aaatacgccc attcgggcgg cgtgcggctc ggcgggctga tttgcaacga gcgccagacg 484441
gaccgcgagc tcgatctcgc cgaggcgctg gcggccaagc tcaattccag gctcatccac 484501
ttcgtgccgc gcgacaacat cgtccagcac gccgagctca ggaagatgac ggtgatccag 484561
tatgccccgg agtcgcaaca ggcggcggag tatcgcgcgc tggccgacaa gatccatgcc 484621
aattccggcc agggcaccgt cccgaccccg atcaccatgg aggagctgga ggacatgctg 484681
ctcgatttcg gcgtcatgaa gaccgacgag cagatgcttg ccgaacttca ggccaaggaa 484741
gcggcggcag cggcccagtg accgccgccg cagacgctgc ccgggacggt gatccggtgc 484801
gacattccac caatggtgcc tcttcttgga ggacacgcaa aaaagggggc aggcccaatg 484861
agcctcgatt acgagaatga cagtgcgctc catcaggagc tgatcacgca agtgctgtcg

Figure 3 (Cont.)

484921
cagtacccac acaaggcggc caagcgtcgc caaaagcacc tcagtgtcgc atcggaccgc 484981
gaggcggtcg gggaggaggg cgagaccctc tccgaatgcg acgtgaagtc gaacatcaag 485041
tcgatccccg gggtgatgac gatccgcggc tgcgcctatg cgggctcgaa gggcgtggtc 485101
tggggcccgg tcaaggatat ggtccacatc tcgcacggcc cggttggctg cggtcaatat 485161
tcctggtcgc agcgccgcaa ctattatgtc ggcaccaccg gcgtcgacac cttcgtgacg 485221
atgcagttca cctccgactt tcaggagaag gacatcgtct ttggtggcga caagaagctg 485281
gaacaggtca tcgacgagat cgaggagctg tttcccctca acaacggcat caccatccag 485341
tccgaatgtc cgatcggcct gattggcgac gacatcgaag cggtgtcgcg caagaaggcc 485401
gccgaacacg aaacgacgat cgtgccggtg cgctgcgaag gcttccgcgg cgtctcgcag 485461
tcgctcggcc atcacatcgc caacgacgcc atccgcgact gggtgttcga caaggcggac 485521
ggcaagacgg acgtcgagtt cgaaaccggt ccctacgatg tcaacgtcat cggcgattac 485581
aacatcggcg gcgacgcctg ggcgtcgcgc atcctgctcg aggagatcgg gctgcgcgtc 485641
gtcggcaact ggtcgggcga cgccacgctc gcggaagtgg agcgggcccc cagggccaag 485701
ctcaacctca tccactgcta ccggtcgatg aactacatct gccggcacat ggaggaaaga

Figure 3 (Cont.)

485761
tacgccatcc cctggatgga atacaacttc ttcggcccct cccagatcga agcctctctg 485821
cgcaagatag ccaggcattt cggcccgacg atcgaagaac gggccgagag ggtcatcgcc 485881
aagtaccggc cgctggtcga cgccgtgatc gacaagtact ggccgcgcct ccagggcaag 485941
cgagtgatgc tctatgtcgg tggtttgcgc ccgcgccacg tcatcaccgc ctatgaggac 486001
ctcggcatgc agatcgtcgg caccggctac gaattcgccc acaacgacga ctaccagcgc 486061
accggccact acgtgaagac gggcacgctg atctatgacg acgcgaccag ttacgaactg 486121
gacacgttca tcgagcggat ccgccccgat ctggtcggct ccggcatcaa ggagaagtat 486181
ccggtgcaga agatgggcat cccgtttcgc cagatgcact cctgggatta ttccggcccc 486241
tatcacggct atgacggctt cgccatcttc gcccgcgaca tggatctcgc catcaacaat 486301
ccggtctggg atctctacga cgcgccctgg aagaaaatga ccgtgccgac ggccgcagtt 486361
gcagccgaat gatcggccgg tcttgcgcgg cacgaggacc gcggcaagac cggaaacctc 486421
tcgaacatcc ctgggcctaa gaggccagat caagaaggtc aaacaccatg ccgcaatcgg 486481
ctgagaagat actcgaccat gcgccgctgt ttcgcgagcc ggaataccgg cagatgctcg 486541
cggagaagaa gctgaacttc gaatgtccgc accccgaacg gctcgtcacg gaccagcgcg

aatacagcaa gggctgggaa tatcgcgaga aaaacctcgc ccgcgaggcg ctcgtcgtca 486661
accccgccaa ggcctgtcaa ccgttggggg cggtgttcgc agccgccggc ttcgagcgga 486721
cgatgtcgtt cgtccatggc agtcagggct gcgtggccta ttatcgctcg cacttgtcgc 486781
gccacttcaa ggagccggct tcggccgttt cgtcctcgat gaccgaggat gcggcggtgt 486841
tcggcggcct gaagaacatg gtcgacgggc tcgccaatac ctacgcgctc tacgatccga 486901
agatgattgc cgtctccacc acctgtatgg ccgaggtcat cggcgacgac ctgcatggct 486961
tcattgagaa cgccaagagc gaaggcgcag tcccgcccga attcgacgtg ccgttcgctc 487021
acacgcccgc cttcgtcggc agccatgtcg acggctatga cagcatggtc aagggcatcc 487081
tggagcactt ctggaagggc caggcgcgca cccaagcggc cggcacgatc aacatcatcc 487141
cgggcttcga cggcttttgc gtcggcaaca accgcgagct tcagcgcctg ctcaccctga 487201
tgggcgtgtc ctacaccttc atccaggatg cctccgacca gttcgatacg ccgtccgacg 487261
gcgaataccg catgtatgac gggggcacga cgatcaaggc gctgcgggcg gcactcaatg 487321
ccgaggcgac gctgtcgctg cagcactaca acagccgcaa gacgctcgaa tattgccggg 487381
aggtcggtca ggccaccgcc gccttccatt acccgctcgg gatcaacgcc accgacgcgt 487441
tcctgatgaa ggtgtcggcg atttccggcc gggaaatccc cgagacgata cgcctggaac

Figure 3 (Cont.)

487501
gcggccggct ggtcgacgcc atggccgaca gccaatcctg gctgcatggc aagacatacg 487561
cgatctacgg cgatccggac ttcgtctacg ccatggcccg cttcgtcatg gagaccggcg 487621
gcgagccgcg gcattgcctc gccaccaacg gcacggcggc ctggcaggcc gagatgaccg 487681
agctgctcgc ctcttctccc ttcggcaagc aggcaaaggt ctggccggga aaggatctct 487741
gggccctgcg ctcgctgctc ttcaccgagc cggtcgacct gctgatcggc aattcctacg 487801
gcaagtatct cgagcgcgat accggcacgc cgctgatccg gctgatgttc ccgatcttcg 487861
accgccacca ccaccaccgc tttccgctca tgggctacca gggcggcctg cgcctgctga 487921
cgacgatcct cgacacgatc ttcgaccgcc tcgatcgcga aacgatgcag acggcggtga 487981
ccgattattc ctatgacctg acccgctaaa agcggcggtc ggcaaaacgc cggcccggga 488041
accgcaccat gggatcgcga gcgttgaaat gggctgatcg tttagctcat gcgctatcgg 488101
aactgcgctc ggaagtgcat tcggacagcc accttatcat tctaaagggg catagcggca 488161
tatgaatttt gcatggagag agacagacgg ttggtagtat tgccggccac tcacgggatc 488221
gcctcgatta aagagggccc gtgcttcagg acgaggacta aatgatgaca gcgttatctg 488281
atccccggtt tactcgagct gtcagtgacg atggatcgtt ggccacccct ttcatgaaat

Figure 3 (Cont.)

488341
gcctcgcgcg gttggtccgc gctcatgatt cctacggatt atggaaggat aaatgtgacg 488401
ccgagttgct ggccaacttc acagttacgg aggagcagcg gcgagctatc cccgtcatcg 488461
gcgaccccga gccagacgtg ctgttgaggc tcgacctttt ttacgccgcc gtcggcgtcg 488521
ttatcgagga gcgctcgggg cttttgatct cgcgaacgct ggagatcagc gatgagggca 488581
tcggccgagt gctcttcaca accaggcggc tggtggtgct gtcgaagacc ctacgtgacg 488641
ttcaccggtt cggcttcaat acacttggca aatgcgccaa gactggcacg aagttggtca 488701
aggatgcgat caaaagcatc gaaacttatc cggacgtggc gcgggcataa tgtgcctgca 488761
aggaataaga ccatgacaga tcttgaagaa ctcaagcaga gggttcaaaa actgcagtca 488821
cgcgctgcga ctgcgaagac gcaattgcat gaccttgccg agtgccttcc gaactattgg 488881
accgaaatag tggccgtcgc cgaaaaaaca ttcgacgctt ttgctcagtt ggacgctgcc 488941
aaaagagaac tcgccgcgtc ggagaattca cgatgaaaag ctcgttcgtg acccgccgct 489001
tcagctggtg ccggaatatc tattatgcat cggctgcggc tgctgactcg ggcgcgagg 489061
tatgcacctt cacgggatca atgacgcagg tgaaattctc ggtgttttgc gacgccgagg 489121
acgatcattc cagcaaccag atcatgtgat catgtccggc gacagcgccg gccgctgtat

cggctgcgga gccggagtgc gtgtttaccc aaactgccag aatcatgttg cggccgacga 489241
cattgccgca tgatcccaca aacaaaccag gaaaacggcg ttgtcttttg gtatctttca 489301
tcgaattcta tggctgttcc tgtgcgccaa cactcttata gtctacctcg taacggggtc 489361
catcagtgac gcagtcgtca cgactatggt tggttcgctg cttctgcagc taacttattt 489421
cgcaaacgta ctctttctgc tctggcgggc tcactgcgcc cggagagctc gtcaaacgac 489481
cgggcaattc catggagagg aacagccggg ggaccctcgt atagcgggca ctcacgggcg 489541
cacggatggg gatccgtgct tcgaggacga ggactctcga taggcccctt gctaaccgct 489601
tcatgaaatc tctctcgtgc ggctaaatcc ccgctcagct ttgctttcgg tgtgcaagga 489661
caagtgcccg cgctggattt ctggccgact tcactgtcac cgaggaccag cgccgtgcga 489721
ccgcgtcagc ccttgaagcg cggaacaaga gagtgcgtaa gctgcagccg ttctggaaag 489781
cgaacatgga atttgcgtaa tgtcgccaag gaccttccaa tcaatggagc tgatcatggt 489841
agtcgccgag aatacgttgg cgcctttgct caggttagcg ctgccggatt gctgcccgac 489901
ggcacaatct ggggaatgct accgcttcag atggtcctac attgaatctt actgtgggtt 489961
ctccctacag atgcgccacc ttttaacata atcttgacga tagtgaaaag tgatgctgga 490021
tctgacgaat gcgaagcgca taggaatcat cggcggcggc attgtcggtt ggcttgcagc

Figure 3 (Cont.)

490081
gatagcgctt cgccgtgttt tcgacgttga tgtcgatgta acggtcatag aggctccgac 490141
ggtgtttccg cttggcccag gggagggggg ctcgctcaac ctgattgaca cgttgtgtcg 490201
caatgagctc gacctggacg ttttcattgg tgaagccggc gccacccaca agcttggtgt 490261
gctctatgaa aattggaggg gtggaggaat cccggatcgc tactaccgca tgttcggcgg 490321
atcgggcata ccggaaatcg aatgtcgcgt cggcggtttc ttccctctgc tgtcggcgag 490381
aattgccgca ggtgagaacc ttcacacgtg catccctggc tttgagttaa tcacaaagaa 490441
ggcatcgcaa gtggaaatcg acgagttgct ggcaaccggt gagtctggac tctacccttc 490501
gtttcacttc aatcacgccg gcttcgagcg atacctaagg cgcgtcgggc tggcacgtgg 490561
gatcacttct cgtagggctg tggtacacgg gatgagactc gacgaccgag ggcatgtaaa 490621
cgctttccag ctcggaggcg aagaacttga agtcgacttc gccgtcgatg cgtccggatt 490681
tgccagattg ggtctcggca aagtctttaa tacgcgctgg tgttcgttcg caaatgtgct 490741
gcctactgat cgtgcgatca tctttgagct tgagccgcgg ggatcatccc ccgttacccg 490801
tgccaccgcc atgaaagccg gatggatgtg ggaagcccca ttgaatcgct cgatcagtgc 490861
cggttatgca ttcagcagca gatatgcgga cgctgcgatg gcaatcgccg aggttgagaa

Figure 3 (Cont.)

490921
tcactatgga ttccgtgtgg aggcgaaaca cgagctttcg ctggatcaag gttacttttc 490981
gaccgcatgg gttaacaatt tcgtggcttt gggaacagcg tcgggttttg ttgagcccct 491041
ggaggctgca cttgccgccc acaccttcga agcgttaagg aatttggagc gcattctcgc 491101
caacggaagc ggcattgtgc ccgctcgggc catcgaaggc tataacagcg caaacgcacg 491161
gtgctggacg ggtgttcggg acttcctgag gctgcactac gattccaagc gaattgacac 491221
accgttttgg cgagatcttg ccgcagccga gttgccggaa ggatatgcca acctgagggc 491281
ttgcttccaa aaacggacac cacgctttat cgatatccaa ccgtatgtcg gaagcggatg 491341
gcagagcctc ttccacgaaa ttgattggat ttcagtggcg gtccctctag gagtagtgcc 491401
gcaggcggcc gcatgcgccg aactacgcag gctctctacg gaaagtcgaa gtgaggtcca 491461
ggcctatgtt gatcggctga agggaacaat agccaagatc agcagcacga ggggatacat 491521
gcactaatcg tcacacaaaa gccactccgc ggccgaagcc gtgtaccagg gtcttgcttc 491581
atgatcatgg cggagcggca cattgatcgt gagcagggtg tctcaaagcc ggtcaaatcc 491641
gcggctgcga acgactaggg tcgatattcc actgaatcac gcggagctgt catgtgcaac 491701
gcttcctgta gtagtacctg ccgcatccag atgctcgcct gatccctgtt gtgtaggcta

ggccactgga cagcttgggc gaatggtgga agtgccagtg gaagttcggc gacccgcagc 491821
ggcgttgttt ttgcgaaatg ttccaccagc cgcaacggca tggtcgctat gcgatcggtt 491881
cccgacagca aaggcgggat tagactaaat cccggcacga cgacttcgat acgcctcttg 491941
agaccgtgct caagcaacaa ccaattctcg atggagggct ttagcgtacg tccgaactta 492001
gccgcaatat gacccatcga tccgtagttt tcgaaagaaa gctgccgttt taactgcttg 492061
ttagtggggc aacctacgca aaccagcgtg tcgtcgagca gtttcgcctt tggatgatcg 492121
ctcgacgcga acaattccgg aaggatcacg aaatcgacgt caccgtaccg gagaagttca 492181
tcgggatcct cagtgagagg cagcaactcg aagccgatgc caggcgcctc tcgcgccagc 492241
cgcttcacga ctctttcaaa aaacaccagc atcatgacgt cggaaagcct gatcctgaag 492301
cgtcgctccg actgaactgg gttaaacata tcccaagaaa tgatggagaa ctggatgtgc 492361
agcagagcat cgcggactgc gggggcgagc gctatcgcac gcggagttgg gataagttcg 492421
cgacctcgca tcgtgaacaa gtcgtcgccg aaataggtgc gtaggcgggc gatggcggcg 492481
ctcatggccg gctgactgag gttgatactg cgagcagctg cggtaacgct tcgctttgtc 492541
atcagagcat cgagcgctac gagcagatta agatcaagtc ccttaaaacg cattatataa 492601
ttcaaccaaa gcgtttctgc cctcatagaa caggtagttt tcagtgatgt tacagagtga

Figure 3 (Cont.)

492661
gcgccgttgc cttgttcccg ctgctcagaa gaacatgagg gagtggagcg cactccgtcc 492721
cgagtaccgt aaagagcggg actatcccac cacattcgac acaccaaatg agtggtgcgt 492781
tgcgacaaaa cttcggcttg cagaggcctt tccagcgtgc tgatgagaat ggagtgcaac 492841
ccggaccccg gcactttcgg gagctgacgt cggtgaccag ctgttccccg ataacagagt 492901
gaccctcggt tagcctgttc ttcaatgcga tattggtttt gcgggcggtc tcaatttcgg 492961
acgtggtttc caatctgctg ggggcatcag tggctccggg cagtccgcag ttttcgagcc 493021
gatctggcac gcggctgtgg aactcttcgc ccatcgcctc aatgaaccat tcctgcgtgc 493081
cagcaaaggc cttgagttcg accctcttta gcgacgccga cctcctcaac ccgatcgacg 493141
cgtcgggtta atgtctcgac agcaggatca ggagaggaca ccggttcgat ccactgcgac 493201
ccgcccagga tcacattgtc ttgtgcgggc gtgccgcctg gctggaactt tcctgagtgc 493261
atcaatggca tccttctgat aatcagacga agcgatggcg gatactagtg ccgcatcgac 493321
ccggtcgcgc tatgcaaagt tcatatcccg ccatgcgctt gagatatggt tctaaactct 493381
ttgcaggatc agtgctgcca gccgaacagt cctgacccac agatggagta aaacgaccga 493441
cctctcactt tcgcagagga cgaatagctc ctgattgaac cttcaggagc ttgacatcgc

Figure 3 (Cont.)

493501
ggactgcaga cggcaggcga cacacccgcg aagccttttt gtatgccagc ttgctcctag 493561
tttcttagtt cgccgcgaat cgcctcactt caaccgcgtc ggaaccaaac gttgatccga 493621
tgtgatgagc cattaatgcc agacgtgccc cactccacat tggtttccga agagcaccat 493681
taaatctgcg cccaatatct actgctgctg ttaatcagcc tggctgacag aaagctgacg 493741
cggaggggtt agggcgttgt tcatgtacat ccacaaaact tcctccagcg aatttaggat 493801
tgggtaatag tcattcgcgc tagtgtgttc tggatgtcca tcagtgttcg tctcgcgatc 493861
cttgatcgaa ccggagctcg ccgttcagcc tgagtggttc atgtaacggc aaagcagtgt 493921
gcgacgatag ctcgaccccc gaagtaaatg tagcgaaatg catccatgat gcagatgcct 493981
tcgatccgaa gaatcgattt gctcaatcag tttctcttaa ggcaaaggct gatctaatga 494041
aggtgtaagg gatatcaatg cgcagagaaa tctcaggtgt atttttggca tcatgggctc 494101
gccgaccggt gtatttctgc tcgtcaacag accttcgccc ccgctatcac aggtgtttgg 494161
gttacatgct ccttcgatta gccctcgcac ggagcgggta cgaaaactgc gatcagtcgc 494221
gcggtactgc tgtcaccccg gtcatagtcc gcggtgacgt gctcaattgg ctgtcctgcc 494281
ttgataggag aatgaaatgc gaacgttgct cgtggatacg gatcttaccc gcgcggtccg

aggcgcgctc ggtgacggcg gctttgccgt tgatgtagtt ggcacgctgg aacaggcgtc 494401
gagcgcattt ttttcagcga gctatgaaat tctcctgctg gagttggtac tgccagatgg 494461
cgatggactg gattggctga ggcagctaag gagcgacggg tattcagttc ctgccgtcat 494521
tatgagcagg ctcgacgatc tcgagaaacg aatttcggta ttcaatagtg gcgcggacga 494581
ttttctccgt aaacccgtct ctacggatga gctcatcgcc agaatgcggg cccttctgcg 494641
ccgatcgaca cagatcactt gccccatcat tgaatttggc aacctccact tcgatccgat 494701
cggccgacag gtgtcggttg acggtcatcc gctaatgatc gcacgtcgcg aactatgcat 494761
tctagagcat ctgcttaacc gcgcaggtcg catcgtgccg cgtgcgcggt tggaagatca 494821
actctattcg ttcaacgacg aagtttcagg caacgcgctt gaagccggaa tctaccgctt 494881
acgcgggtat ctcagtaggt caggtgccac gttgcggatc aggaccgtgc gcggcattgg 494941
ctacactctt gaattgactg acgcgtcatc agcatagtcg aatttgaagg aaggactgcc 495001
ttgaaagcca ctccaactgg tcatgctagc gccgatcgat ggccgacccc catcgtcggt 495061
tcaaggccaa ctgttccata ctggagcaat cttctctacg cgctcgttct gttgtctcct 495121
atgtccgccg ctgccgaaaa caacggggat gaagcggtgc ctcgtgccgc tcccaacagc 495181
atcaacgcca cgctgaacct ttcctcttcg ctgggcaaga cagttcattt gcccgcgcca

Figure 3 (Cont.)

495241
gccgcgacca tctttgtggc cgacccaaca attgctgatt atcaggcacc ctccaataga 495301
acgatcttcg tctttggcaa gaaatttggt cggaccagcc tattcgctct ggacgaaaac 495361
ggcgaggctc tcgccgagtt gcatgttgta gtaacgcagc cgatcgcaga tttgcgtgcc 495421
atgttgcgag accaggtcgg cgactacccg atccacgtca gctatacgcc acgcggcgca 495481
atcctcagcg gtacagcgcc caatgccgaa gtcgttgaca ttgcaaaaag agttactgag 495541
caatttctcg gtgacggtgc gccgatcgtc aacaatatca aggtcgccgg ctctttgcag 495601
gttaatctca gtgtgcgcgt agcggaagtc tcccgcagcg gtctgaaagc actcggcatc 495661
aacttgtccg cgttcggtca attcggcaat ttcaaggtgg gtgtgttaaa cagaggtgct 495721
ggacttggtt cggcaactgg tagcggcggt acagcagaaa tcggattcga caatgatgct 495781
gtcagcgtcg gcgcggttct cgacgcgctt gctaaggagc acatagcttc cgtcttggcc 495841
gagccgaacc tcactgctat gtcgggtgaa actgccagct tcctcgccgg cggcgaattt 495901
cccattcctg tcctgcagga aaatgggcaa acctcggtgg aatttcgccg cttcggcgtc 495961
agtcttgaat tcgtaccaac tgttctcgac aacaacctaa tcaacattca cgtaaagccg 496021
gaagtcagtg aactatcgtt acaaggtgcc gttcaagtca acgggatcgc cgtgccggca

Figure 3 (Cont.)

496081
gtttccacgc ggcgtgccga tacagtcgtc gagctcgcga gcgggcagag cttcgtgatt 496141
ggcggtctca tcaggcgtaa cgtcaacaat gatatcagtg catttccctg gcttggccga 496201
ataccgatcc ttggcgctct gtttcgttcg tcctcgtttc aaaaggagga gtcggaatta 496261
gttattttgg ttacgcctta catcgtcagg ccaggctcca accccaacca aatgagcgca 496321
cccacggacc ggatggctcc ggctttgggc actccgccgc gagcccgcgc tgctatcagc 496381
accgacgcgc caagcgtcaa gggcgatctc ggcttcatca tcgaatagtg gtgccgaatg 496441
acgttgcgga tcatagctca cctgctcgct ttgacagcaa gcttagcagg ctgcacaagc 496501
actgcaccga tctatgtcga gcaaccgaca ccgatttttg tccgacagga gtccaccgtc 496561
ttgaagttgg agagctttca cgcttccgaa cagcagcgtc ttcttgcctt cctatggaag 496621
gccagtcgcg gccggaggga tgcccttcac ctcgttatca gcgggtcgtc ccggctcagc 496681
gcagaggcgg tccatcaagc cagacagatg ggcatcggcg cttccaacat ccatttgctt 496741
gaccaaaatg accgcgggca cctgcggata gaggccgttg tctatcatgc cctccctcca 496801
atctgccggt cgctttccag ccagttactt aatgacgaat tcttcgacca gccgatcggc 496861
tgttcgacga gccataatct ggcagtaatg atcaacgatc cgcgcgattt gctcggcaat

agatttgtca agcccagcga tggtgatcgg gcggccatac cagttaccac ctacaggacc 496981
tcgacgggta aaggtggctt atgaggcatg aacgcgactg ttctcgatga tcgcttcatc 497041
cgggttgggt gtcccctcaa ctcactcaac ccgcatgagc ggcgcggcgc tcccgacttt 497101
gtttaccgcg gttgcagtca ctgagaatgt ggcgagatcg gatgggatca cttgccggtg 497161
tgtcagtcgg cacggaaatt gttgagcccc tatcggcgct tgtgcacaag caagatcgat 497221
cgacgcccag acagccagtt agagggtcgg tacgtcagtc tcgccgatac gaagctgagt 497281
cgacgtgtat ataggtctga ctgcgtcaat atcttggacg cttgtaacgt ttggcgccgg 497341
tcagacgggg gtgctaagaa ttcctgcccc tttcagggca tacgctgtgc gcttcgatcg 497401
tgaacgccta ctctgcagga aagcccgcac ccgagtccgc agatcaaatg tcaaaatcca 497461
ccgatggcct gatgcgaatg actccctcgc ctcggaattc ggcaacgtgc cgcatgccca 497521
tcatcaaaaa cgttgttgtc gggacctctg cggttggcat tagccccgtg gccctcagca 497581
tgctcatctg gtcttctgag gccatgtgag gagctaagaa ccagtggtcc cacgcacgaa 497641
cgccgctatc cataacgaaa tcagaaagtt cagccggctc ggcccctgcg gacgaggacg 497701
gccaagcgtg cgatggccgg gcttgcgacg gtccagagtg tgatggtccc acctgccacg 497761
gtccagcttg cggccccgcg gcatccacgc gctgccatat caaatcctga tcgtattcgg

Figure 3 (Cont.)

497821
gcacctgcag cgcgcgagca tgcggttgct gctcgctagg ctggggagac cttcccctct 497881
cagcggtcag tggcgcggga gaagctgtag cccgcgtatg caggtcctgc tgccaatcaa 497941
gcaatgacgg attcgcccaa tccaaatact gcgagtaggg atgcttggtt tctaagtcgg 498001
tggcatgcgg cggtgggctt gggttcagtg gggtggcgga cggggatagc ccggcttgcg 498061
acggtccaga tcgtgatggc cccacttgcc atgatccttc tcgcggtccc gcggcttcca 498121
ggtgctgatc ctggtcgtgt tcgggcgcgc cctgtagcac ccgagcatgc ggtcgctgct 498181
cgctaggatg gggagacctt tccctagtcc tggtatacag gtcatgctgc cattcacaag 498241
gtgatggata aggatatgcc gaatccaaat actgcgagta gggatgcctg gtgtccaaat 498301
atggggaatc ggcttcaacc tgcggcaata gtgagtcagc ggcatgtgga gggctatatt 498361
gaaatccgct cagctgatgc gcaaatgcac tcgcgttggc gggtggtgga gagtccggct 498421
gtgggcttgc gtttagtggg ctggttgaat tgatatccat cctgtttctc ctttgaaata 498481
tggaggcccc aagcctttcc gatgcggagg cggcatcacc atctaatccg ccctgcaatt 498541
gttaagagac atacctttcg agaagctgac aatcagatgg accgaatgaa gaccggactt 498601
atgtccgctc gaacgtcgcg tcgctggcga aggccgttga cagatccagg atgatagaga

Figure 3 (Cont.)

498661
caacagctgt caacatggca cgcgccaaga gacaatgttt caacacgata tttcttcttt 498721
agcgacgtga ttggcgcgcc ttcagccaca ggccgagcgc cacgagaaaa gacaggccgt 498781
agaggcccgt gacgagcggg aaagctgcct tgagcccaaa ccgttgcgtg gcggcgactc 498841
ctgcaatgat cccgacgacc gaagcgccct gctggcaggt ctgcgcaagc cccaggaccg 498901
atccctgcct ttcgcttcgc gtcgcggccg agacgagcga caggagaacc ggtgtcgttc 498961
ctccaagcag cgcgccccag gtaaaataga gcgctgcgaa cagccctatc gcacgggtcg 499021
agccagcgag cccggtggcg acgaagcatc cgccagcgat cagcacgtta catccgagca 499081
caaaagacgg ctctcgccct tcgaaggtcc gggcccacac cggcgctgcg accacaaagc 499141
cgagcgcaag aaggccatag ctcaatcccg tgatccaatg ctgagagccg tagacctccg 499201
acatatagag ggaaaagggc acctgcagca ccatcctgct cgcaagcagc aatcccatca 499261
gagcaagtag tccgaacacg gacacccccg tggaaggcgc gcaagagact gttgttgctt 499321
tcgcggtttt cgtgagtccc gctcctccta gtggaaccgg caggcttgtc caggcgactg 499381
cggcacagaa tgcgcagatc accccggcgg tgaggttgac ggccgcaaaa ggcaaggcgt 499441
cgaggatgag cccgccgagg aaagcgccgc ccagggagcc gacattcgtc gccacctgca

gccaggcgaa gaggcgggcg cgatcgcgcc cgccggtgac ctcaacgccg taggcctggg 499561
ccggagcgat atagccagcg caggccccct gcagaaagcg caacgccaga atggtccaga 499621
catcctgggc gaaggcgacg agcagttgcg tgatcgccag gcccagcaag gcccggacca 499681
tcatcaggcg attgccgtac cggtcgccca tacgtcccca aaaggcactc gtcagcgaca 499741
cgccgagcat cgggcagacg tagacgccga tacccgcgag gccaaagacg ctgtccgagg 499801
ggctcaatgc cttgatctga atcggccaga agggaccgtt catctccatg gcgcccatgg 499861
agatgaattg aaggccgaac agcagcgcga agaccggtcc gaaaccgcgc aggaccgcga 499921
ctgtcctggt cattccgcac tcgccaacgg attgggcaat tggtgctcga tgcggtagtc 499981
gcgatagcgc tcgagatgca tccgcaggac cgagcgtgcc ggccagggcc gttcgaggaa 500041
ggcctggcgt tcctcgagcc agaacgcatc cgagagcatg cgcggccgca acgtctcgaa 500101
cgcctcttcc gtttcttccc tgaggacgcg ccaaaggctg tcacccgcaa ccgaatattg 500161
ctcggtcagg caaagggcga tctcgtgaag atggcagaca aagcacgcat tgatgaggaa 500221
cgagcgcacg aggctgatat cgtcgtcgaa ggtggttggc aggatgcccc ctcgactgaa 500281
cggctgcagc tcataaccgc gttcggtgaa gagcggtgca aaactgcggc cgtcaccgaa 500341
atcgcggatc aagagcttcc gtggcaggcc gcgatcatcg aaaagaatcg tgctgttttg

Figure 3 (Cont.)

500401
ttgatgcgcc tcgaatgcaa tgccgtagag gagatacatg gccagagtcg gtcggacaac 500461
ggtgcgagca tagagccgga agaacgcagc gatcgccgct tcgctctcgt cgccgctttt 500521
tccgatgagt tcgcagatca gtggccggcc gtcgacaggg ccagcggtca gaagcgcggc 500581
gacggttacc ggcagcaagc catctcgacg ggcaagagca tcggccttgc gatagaccac 500641
cgaaagaaag cggccgagat gctcgtcgcc ggtttcggga tgacgcagaa tcgccccaag 500701
ctcttcagta aggatctcca gcctgcacct gaggtcatcc tcctccgaca caatgtcgga 500761
aatcagcgtg ctgaggcgcg gtcccatatg gatcgacttc gcctgcagcg tccgctgctc 500821
gctcgtcatc cagatcgcaa ccggcagttt gatgaagggt cttggcgcct cggtcgtcgg 500881
cagcatcgtg cgaaacgaca tggacggcaa cgtcacgatc tccgggccgt caggatcgaa 500941
aatgccggct tcgatctctg ccgcgaattc gcggcgcacg aagtgctcca gatgccaggc 501001
gtggacgggc agaggcagcc agtcctcggg tgactggccc cgcgctttca ggccctccgc 501061
ccaatcgcgc gagaggtccg ggaagttctc agcgaaccat tccgaatagc ttccgacgtg 501121
cggcatcttc tcgacgtagg cccagctgct gcggagcgcc gcaatgcgca ggggcacgcg 501181
cgcgccgaac tcgggggaca gtgcggcgac ctcctccgcc gccaggccgg gcttggcctt

Figure 3 (Cont.)

501241
ccaggtcgga tagaacgggt ggccttcgag cgcgccccat tggtcgaggg tcatcgcggc 501301
caaatgcgtc ggcaagcttc tttcgagata ggcaaggaag ccgggcgcac cggcttcggc 501361
gatttcctgg cgcagcctgg cgctccagcg cccgcgctcg cggcgcgcca gcatgtcgtt 501421
gcgcatgctg ttgtccacgt cgcgcagcag atgctccagt ccgtcagaag cgggcgtgat 501481
cgcgagagag gaggcaacct cccgcatcag ggcggccgga tcatcgatcc gctgccgtgc 501541
cccggtgccg tccagcactt cgatctgtcc gcggttccgc aaggttccgg cgggcgcgag 501601
gctgagatcg gtgaagtgca gcatgcgctg cgagggccag agggggaacc aggcctggcg 501661
gccttcgcgt gcccacagca aggcgttcgg cgcgagcagg cgctcggcga acaggcagcg 501721
caccagccgg ttgatcgcgt tgcgcgatgc ctgcgtcaaa agcgcaagat cctcgttctc 501781
gacgggattc gtcacggagg gcgtcttctc gtccatcagg cggcctccgg ccagtcggct 501841
gggacatagt ctggtgtacc cgcagccaat ttgccgtggt agtcgcacgc ccagcgatag 501901
atcttggcga tcgccggtac cgtcgcctcg agccgttctg ccatcgtgac gagcagcgcc 501961
tgtccgaaag cgatatcctc gtggaaggcg cggcttccgc gatcgatgac gagccccggg 502021
ccatgtggat tgggaacgag gggggcagga atgcccgcat aggcgcgatt tgtgcgtaga

agcgtgtaca tggttcggtc atccccaatc tggtcgccat aggcctcgat cagttcctgc 502141
tgaagcggct tcactgagct gagatcaatg ccgagacgtg cctcgctcgc ccggcggatc 502201
gcttggtttt ccgcatcgca agcttccagg agctcggcgc ctgcttgtgg gcagtcgctc 502261
caccagcaca gggcttcgtc gaacggtctt ttttcccacg gtgcgccggg gccgatgagc 502321
gcgtagagca cggccgggtg catcagcgcg ttgcccggcg tcagcgtgat ttcgagatag 502381
tccttgagca ggttgacggg cgcctcgtag atgtgattca acatcgccat cagtgcggcg 502441
gcgctcgcag cgctttcccg gcgatgcagg gcaacgaaga gctctgcctt ggcgccgccc 502501
atccgcacgc gctggcctgc aatcagatca taggcgatat ggggcacgtc cttcatgccc 502561
cagatcacca cattgtcacg ccccgaaagc acctttgccg cgagccagtc gaagccgcaa 502621
aagccgggaa tcgcgccgat atagacgctc ttatccgtcg gcaaatacgg cgctatacga 502681
tgcaagagcg cggatcttgc ctgggcgggt tgcgttatga ggaccatgtc agcgttgtcg 502741
agcgccgcgc tcgggtcggt tccgatgtag tcgggcctag cactcagggt gcgaccgtct 502801
cgcgtcaccg cttgccagag accgtccccg ctcgcccatc gcgcggccac ggtggcggac 502861
gtggtcagga ccgaaacatc gatgcccggg ttctgcttga aaaggaccgc attcaaatgt 502921
ccggtgcggc cagcgccgca aatggtcacc ttcatgctgc ccgcgccttt ccgaatagcc

Figure 3 (Cont.)

502981
agccatccaa ctgggcagcg attgccgggt cgagcaggcg gcgcttcgcc atccattcct 503041
catcgaaaat cgtgccaaga tatttctcgc cgccatcggc aaccgtcgtg acgacggtgc 503101
cggtgagctt gccggcgcca atgaactcca gcgccttgta gatggcgccg ccggtcgagc 503161
cgccaacgag cagtcccttg cggcgggcga tgtagcgcgc cgtctcgaag gcttgcgtat 503221
cggtcacctg cacgccttcg tcgatgcagc catagtccag caccttgccg acctcatcgc 503281
cggcgggcgt gcccgttcct gactggtaat aggggtgccc cggcttgccg aaaacgatcg 503341
agccggccgg ctccacggca atagtgcgta cggccggatt gttacgcttc agacgctggg 503401
agattccggt catcgagccg ccggtcccga cgcagccgac aaaggcgtcg atgccgtcgg 503461
gaagctgggc aaccagttcg tccacgaggc cggtatagcc ttccggattt gccgggttgt 503521
cggactggtt catgaacagc gcgcccggaa gctgcgcgcc gagttgcgct gcgaggcgct 503581
ggcgctcgac gactgcgacc tcgtcttcgc gaaagtcgcc ttcgacatag cggatctcag 503641
cccctagcgc ccgcatcatg cggatcttgt cgggcgctgc atggtggtcc accacggcaa 503701
tgaagcgcag cccgaattcc agcgctgcga gcgccagccc cgtgccagta tttcccgacg 503761
atgattcaac gatcgtgccg cccggaggga ggcgcccatc ctgaagggcc gcaatcacca

Figure 3 (Cont.)

503821
tgctgcgagc catacgatcc ttcatcgagc cgccgggatt gttcttctcg atcttcagaa 503881
ccaaggtggc gttgcggccc ggcacgtcga tcgacatgac cggcgtctgg ccgatcaatt 503941
gtgttacggt cgtgtgcagc atctaaacct ctccaattgt gtcgggaacg agattgggcc 504001
gcccttcggc gtcttcgatg acgcagaagc gagcgggcat gggatggcga tggaactcgt 504061
tttcgaggag gtccatctgg tagccgccgg tgttggcgta tacgagcagg tcgccagcgc 504121
gcggcgcggt cgggaacgtc agccaccggt tgctgatgac gtcctcgtcg aggcagctat 504181
ggccggccag ataggcgcgg accggcggca attgaacggt cgccttggtg gcaggcacga 504241
gaatagggtc gatcaggaat tcggaggcga accaagtttc gcaggcgctg aagctgctac 504301
cttcgacaaa gatgacgtgc gaatccggac cgagcgcctt cacccgcgag attcgaaaga 504361
cagtgatcgc cgcctggtcg gccagcgcgc ggccgggctc catcgccagc gtgagaccct 504421
cacgcgccag gtagccggct acgcttcggc cctggttcat ctccgcctcc aagagccggt 504481
gcagccagtc ggctgctgaa agagtgctgc catagggata gaaagagtcc ggtattttcc 504541
cggtgcggta gtcctcgggc gcctgcgccg cgagatgcgc tttgtacctg gctcggtcga 504601
catattggat aggcaggcca ccgccaatat cgatcatgcc cggaaaaaat cccatccgcc

tggcttcggc aatgaggtcg gcggcctctc tgagcgctgc cacacgggtc tcccggcgat 504721
agccgctgag gtggaaatgc agcccgtcga aacgcaccct gccttcaccg gcaagccgag 504781
cgaggcaatg aacgaccgcg tcgggcggca tgccgaagcg gctcttgctt tggtccctcg 504841
gccgcaaacg caagaggatg gactgttggc cagcatctgc cggcagaccg tggatgagat 504901
cctccagttc ttccggcgag tccaccgata tcagcgcgtt gcaattgatc agctcttgat 504961
gaaatgcgct cgtcttcgcc ggtcccgtcg ccacgagcct ggcaccatcg gccccaagcc 505021
gccttgcgtc gcgaagctcg tagaggctgg agacgtcgag cccggcgcct gcgctgagcg 505081
ctgcctgcat gagcccgggc gatttgttgg ccttcgcccc gtaatagatc gcatgctcga 505141
ggcggcgctc cgtcagtacg cccttcaagg cggcaagatt ctcccgcaac gcatccggcc 505201
agaccagatt gagcggggag ccgtggcggg cggcccaatc gaaaagaaga ggaccgtatt 505261
tggtgagaag gtccgcagtc gccgatcgca gaatcggtgg cagcccatgg ccgatcttct 505321
ggcaatgcag cgtcatcaca gcgcccccgc ggaaaagacc ggcgcgatct ccatcggagt 505381
gggactgctc aaaagctcaa gcggcacatc gcatgtcggc aagccgtggg caaaaacgtg 505441
ccgggtcgtc ttgtagggaa acttgcggcc gctgcgcgcc atcgcgaaga tttcagccgg 505501
agtaatgttc ccacctgggc gccaactctc tacccgcacc gaatcattgt cgaggagaac

Figure 3 (Cont.)

505561
cacgggcatc ctggtgagcc ggaggcgatg cgcaaccgtc aaccggtgat agtcgtcaat 505621
cacgaacaag gcatccttct cggctgttat tggcgcggtc catgagcctg cttgcaggat 505681
ttgggccttt agtgcatcga ccctgtcagg gttcacctct tctgttggga tcaattgtgc 505741
tgcggagaga aggcaatgtt ccatgcggtc cggcctcacg ctcgctcttt cgcatcgcac 505801
atatcttgat tatccgcgtt cacgtctagt ctcctgcgcg ttcgctgcct cgtcgctcgc 505861
aaatgtgcaa gcgacagcgg ccggcgaggc gcggtgagga tacccacatg gcaaaatggg 505921
gtcatgaact agccgggaag gccgacggcc taggccggat ggtcggccgc aaggcgtgcc 505981
ttcaggtcgt tcagatagcc ttctgcatag tgctgcgcca ttgaaagcgg cagattaatc 506041
ccggccgtcg cggcctcttc aatcgccttc cttgcgagcc cgttgcgaat agccagcttg 506101
accccgggtc ccgagacaag gccgactgct tgtgctgcga cccctatgcc agcttctatc 506161
agcgcctgct tcatattgcc tccggtaatc gctgtacgga ggagatttgc ggcttgcgcc 506221
tcgcatgcaa gcgtcatgga tacgagatcg gccacctgtc cgattcccgg aatgaagctg 506281
agcactccca cggccgttgc agcccagtca agcactttag atcctacccg cagcacggag 506341
tcgacgacat gcatgagggc tccgccgttc tttttcggtg acttgatgtc aggctggtcc

Figure 3 (Cont.)

506401
gccaggccca tcttcatgtc tgcgacagcg ttctgcgcag cctcagtttc cggcacatgg 506461
aactttggct gctgaacggt gcggtttgcc gtagtcatat ttgtgtagaa acggccaaag 506521
tcttctttgc tgacgttgcc agaatcgacc gtatgtccgc caccgaagtc gaaaaatcca 506581
tgatgagtct tatagcccgt aatcgcattg tttagcagac cgaacagaag aggatctgaa 506641
aggagctgcg aggcagcttc acgtactttc ggatccaagc tcttgtcgtc tgccatactc 506701
gccagcttgt cgcgtgtgag atcaccgctc ccgaaaaata actcctgatg gctgttaatt 506761
gtcttgagcg tgtccagctc ggcttgtgtg aggctcatcg acgaggaggc cacttgcagg 506821
aagtcctctt tgtggacctt atctatatta ccaccgtaca actgcttcca ttcttccgga 506881
tgactgacga agtattgagc cgccgcaatg acctggggtg gacatttgcc tgttttcgct 506941
tcgccgtcga cgatctgctt gaagtcggcc agactcaggt tcttgggaag atattccgag 507001
taccggtaaa gctcccgtag agcatcgttc tcggtcatga ccgatggctg ggcattctcg 507061
gcgctgtcgg atgggatgta gttctgcgcg tagctttgcg cttggctttc ctgaaatgcg 507121
gcaacttgtg ggtgatgttt ggaaaattca gacaagtcct ttgcactgat cttgcctcca 507181
cagcgaccat cgccttgcga gccgattgca taaaaaagtt cgggatcctg tagcaatgcc

tcgattgccg ctttcagatc cggcggagta gagggatcat tggctttagc ctccagcgac 507301
tcccaactga gtgggcacag atccttgtga cggttcagca ctgcgacaat ctgcaactca 507361
ggcttagtca gcgatccacc gttccaggta attctcgagc tttgtatggg agctggcgcg 507421
acataatggt catcgatcac aacagccgac tgcggggtct gatccattga ttcgatcgcc 507481
gccctcatgt gggggggcag tagggccaaa gggtccttct gcaaatcctc caaggtcgac 507541
tcggcatccg gcggcggcag gtcctcccga ctggctaaag gaccaatcct gtctagcatg 507601
ttagtggaca gcatcgcctc gaaggacaat acgctttgct gcccctgggc tacccgaggc 507661
gcgaaagctt tggcgagcga cgcctgggcg aactgtgcag gattagagct gatcattggt 507721
aaaaggttgc tggccgacat tgtgcatcct cagacgtgat gttgtccctc cacaaggacc 507781
ttctataagg cgcttgcgct cacgaagtga caatcttaaa gcctcagctg gagtaaccgt 507841
gcttttgatt gcttcgctcc atgctagcta caaaggtcaa ttccggcaca atggtcggcg 507901
acatcgttgg agctaccgat tcacatcatg agcggtttag ctttcgagaa actgacgagg 507961
ctcagacgaa taacaatcaa gaggtgaccg cagtgaggtt ctaatcctaa agtctgaatt 508021
tcatttcttg ctcagctcag ccttcccgcc atcgtcgttc tctggcagca tctcagaagt 508081
ataaaagact tccggtctcc cgccgcggac gaccgtggtg gaggagcccc gaaacagtac

Figure 3 (Cont.)

508141
catcacagat tccctggcgg gcgtatcggt tgcgcgaggc tgcgcctgcg ccactgccag 508201
tagaccgttc aacgtctgct cgatgagcgc catgaagcgc ggcgggccgg acactaagac 508261
caggccattt cccggcgcgg gtctcaccgg atagcgctca tcagagatgt caagcttatc 508321
gagggcgagc ttgaaagcac taaagtgaac tgaactcaac acaagcatcc gagtttgtgc 508381
ttcttttgca gcagacacat agagcacaac cccgtcataa taccattgga gatcgtagag 508441
atcggtcaat cggtcgagga actcgcgcgg tgacaactcc ggtatacgcc cgcgaatccg 508501
ccccttcacc tctgcgctga tgttaacact gattttcagg ttgttgccga actcctgcaa 508561
cgcggcagag agatcctgat ctagaaccgt atacttatag gaggtcgagg ggagtggcag 508621
ggtggccccg agagttgtgt ggattccggc aaatagaaaa agcccgacac agagcagtct 508681
cctaaacata tgaagcggtg tgaatgggat cggcgttgtc ggcatctcgt cttgataaac 508741
caaatctgaa aatctcccat gcggttcaac tcgactaaca tcactcttca atgggcaagc 508801
gacgctgccg gtagtcagcg tgtcgtcagc tcgcctcgct agagttccac gtcaaagagt 508861
taagtaatcg agtccttctc atgatgctgc ctgtcacgtc aatctctaac agtctcccca 508921
gggtcgcgtc atcgtcattc ggcgagcagg ctcagtttga gcgtgctctg gcacaggcgg

ctgattcgat gaaaaacgat actgcttcaa cgccagtgag gacggcgcct atttctccgc 509041
cgatggacgt tcaccgcgcg gcgccaacga gcccgctgga ggatcgcgtg ctgcagacga 509101
tttcttcgat ttgcccggat agtatagttg ctgctgccgc gcccaaccat aaggcggccc 509161
ttataagcgg cgctccgccc gggccgtcgc agaagctccc tgtcgaaggt ggggcgggca 509221
ccgaaaggtt gggaatcccg caagggggc atgattttga cgtgatggtt gccggtctgc 509281
gggatcttta taatggcgtg acccaagttg ctcttgtttc gaagggtatc agcggcatca 509341
cctcatccgt aaacaaacta ttaaaggaag ggtgagttgc gcgcatgttc ggctcagccc 509401
atggcgacac aacgagcagc gacacgtctg gccggcgacc gcttcgcctc gtcgtgctgc 509461
cacttctcct ggctctgagc agttgcaagg tcgatctcta tacccagctg caagagcgcg 509521
aggcgaatga gatgctcgcg cttctgatgg acagcggggt tgatgcggtc cgggtggccg 509581
gtaaggatgg caccagcaca atccaggtcg acgaaaagtt gctcgccttc tcaatcaagc 509641
tcctgaatgc caaggggctg ccgcgccaat ctttcaagaa ccttggcgaa atattccaag 509701
gttcgggcct gattgcatca ccgaccgagg agcgtgcacg ttacgtctat gcccttagcg 509761
aagagttgtc gcatacgatc agcgatatcg atggcgtgtt ctcggcgcgt gttcatgtgg 509821
tactgccgca taacgacctg ctgcgagcag gcgacacacc gtcatcagcc tcggtcttta

Figure 3 (Cont.)

509881
tccgccacga cgccaaaacg aatctcccag ctctgctgcc taagataaag atgctcgtcg 509941
ccgaaagcat cgaaggcttg gcctacgaca aggtagaagt ggttttggtg ccggtggaaa 510001
ggtccgcaca agagcaacgg tctttactgg cgactgactt ggctcaagca tctaggccta 510061
tcccagagcc gctcctggct gtcgcggtgg gtgtttccgc tgcagtgttc gctgtgacgt 510121
gttacctctt gttcatcgtt cttgggcatc ggcgcaggca attaactggc gaactatcta 510181
gagtccagga gcgccccggt gtttccgctc tcgcggctat tcgtaaaaag ataccggggc 510241
tagggcgtag gtgaaattac caatgccgat agcgatacag actacccaac ctgatgtttc 510301
gttccaatcg cactccgttt ccaggagcga gcttgctgcg tcgacccatc cgacgcgtct 510361
tgccgcccgt ctcgatccgg agttgtcggc tgcgacagtg gtgcagttgc agaagtgtgc 510421
gaggcttcag ccacgactgg cagaattgct gcttggcaat gacatggatt ggaaccgaat 510481
cggatggggg cccgatctcc tgcgcggcca tgatcctcgt cgcgctgctc ttcttgccgg 510541
aagtatttgg catgcccgtt cgcttctgaa agtcgtttct cagcgtgacc tcgcccggct 510601
cgttgaacgt attggcgctg atgcgcacgc atttggcatc cgacatctgg cgcatgctat 510661
cgcagacaaa ttgatctctg atccggaaaa acttgcgttg caaatcgaac acgatggaca

Figure 3 (Cont.)

510721
tgcttgtctt ggtgcttggc tcaacataag gccagcgctt gagcggaatc gcgtgcttct 510781
acgcttgccg ctcggtacag ccgcggagaa cccggcgcct gagcacgatg gtgcctcaag 510841
cgggttgttt tcgctcgtga tagcccattt cgagatggag agcccgtaat atgacagccg 510901
acatttcagc ggcacccgtc gcgccgcaga tgcgcccatt ggggccactg atacccgcga 510961
gtgagcttaa tatctggcac agcgctggag atgcgcttgc cgcagcaaaa cggcatcagc 511021
agcgggtccg tacctgggca cgcgccgctt atcagaggga gcgggcgcgc ggctacgccg 511081
aggggttgaa tacaggcgcc gaggaaatgt cagggctgat tgcacgagca gtcaccgaag 511141
tagcgcaacg aaaggcagtt ctggaaaagg aattgccaca gcttgtcata gagatactga 511201
gcgatctttt aggtgctttc gatccgggtg agctgttggt gagggctgtt cgtcacgcga 511261
ttgagcgcag atacaacggc gcggaagaag tttgccttca tgtgtgtccc acgcaagtcg 511321
atatgctcgc gcgcgagttc gccggttgcg acggacggga gaagcggccg aaggttcgaa 511381
ttgaaccgga tcctacgttg tcgccgcaag agtgtgtgct gtggagcgag tatggcaacg 511441
tcgctcttgg acttgatgcg cagatgcgcg cgctgcgcct tggcttcgag tacctttctg 511501
aagaaggaga actgtgatca ctccggtacc acagcataat agccttgagg ggactcctct

cgagccagcg atctcgtctt tgtggtccac ggcaaagaga atcgatacgc gcgtcgtgcg 511621
aggacggatc acgagggctg ttggtaccct gatccatgcc gtcttgccag aggctcggat 511681
tggggaactt tgtctgctgc aggatacgcg aaccggactg tcgctcgaag cagaggtaat 511741
cggcttgttg gacaatggcg tgctgctcac gccgatcgga ggcttggcgg gtctgtccag 511801
ccgcgcggaa gtcgtctcca ctggacgaat gcgtgaagtg ccgatcggcc ccgatttgct 511861
tggccgtgtg atcgacagcc gctgccgtcc actcgacggc aaaggcgaag ttaaaaccac 511921
cgaagttcgt ccgctgcacg gcagggcgcc caatccaatg acgaggcgca tggttgagcg 511981
gccattcccg cttggggtgc gcgcgctcga tggtctcctc acatgcggtg aggggcagcg 512041
gatcgggatt tatggcgagc ctggcggggg caagtcgacg ctaatatcac aaatcgtaaa 512101
aggtgccgcc gccgatgtcg tcatagtcgc gctgataggc gagcgtggcc gcgaagtacg 512161
tgaattcgta gagcggcatc ttggggagga aggcctccgc cgtgcgatag ttgtggtcga 512221
gacctccgat cgctcggcaa ctgagcgggc gcaatgtgct cccatggcga ccgccctggc 512281
ggagtacttt cgcgaacaag ggctgcgtgt cgctctcctg ttggactcgc tgacgcgctt 512341
ctgccgtgcg atgcgcgaga taggtcttgc tgcgggagag ccgccgaccc ggcggggctt 512401
ccctccttct gtttttgccg ccctgccagg cctgctggag cgcgccggcc tgggtgagcg

Figure 3 (Cont.)

512461
cggttcaatc acagccttct atactgtgct tgtcgaaggt gatggcacag gcgatccgat 512521
cgccgaggaa tcgcgcggca ttctcgacgg acatatcgtc ctctcacgcg ctcttgcggc 512581
gcgatcccat ttcccagcta tcgacgtgct gcagagtcgc agccgagtta tggatgcggt 512641
cgtttctgag acgcatcgca aggcagcatc cttctttcgt gatctcctcg cgcgctatgc 512701
agagtgcgag tttctgatca acgtcggcga atacaagcaa ggcggcgacc ccctaactga 512761
ccgcgccgtc gcgtcaattg gtgagttgaa agagtttttg cgccagagcg aagacgaggt 512821
atcagatttt gaggagacgg tcggatggat gtcgcgtttg acctcgtgaa ttatgcttac 512881
gcttcaaggc tacggctttt aaaggaaatg caagagcgcg acgcccgtag gaagctgtcg 512941
aagaaggaag ctcagcacca catggccatc gtagccgcac agaatgcctc tcgggagctt 513001
gaaatcgcac agcaacagcg tgctggaaag gaagctcaac tctaccaaga actgacatcg 513061
ctgaacacct tgtctagcgc cgcactcgac catcaccacc ttcatataga gcggcttgcg 513121
gctgagatca ctatccgagg ccaggtactt gacgacgcgc gcatcgctca agagcaggcc 513181
gagacagcgg cgtctgagac aaaggccctg tgggtgaagc gttcggaagc acggcacaaa 513241
tggcaacaga tccaggacga cctccggcgc gccgtcgata ttctttctga agccgcaggt

Figure 3 (Cont.)

513301
gagatagagg ccgacgacga gatattgctg cggtatggga ggggttcgct cgaccagagg 513361
tcacgcaacg agttccggta actgcaagtt tctgattgac cgcacgtgca gctaagatcc 513421
gctttgatga ctggcgtggc cagacgcacc atattcgaac cagcgctgac actgtccccc 513481
gaggtcgtcg cgtggatcaa cgacatagcg gcttcacgcg ggccgtttca gagccgtgtc 513541
ggcgacaaac cactttcggt gtcgatggaa ggacttgttt ggcaacacga gtcttctgcc 513601
attccgatgt ttgactgcgt ttgggatttg ggaggtgaaa cggtcgtctt gtcgctctct 513661
cggccgcttg tagaggcgct cgtctcgaca gtgcagagcg ggcttgcttt tcctaccgag 513721
ccaactgcat cgctcattct cgaacttgcg ctcgagccgc tcatcgctcg actggaggat 513781
aagacgaacc ggaccttgca tctccttcgc gtgggtaaag ccataacatt ggctccttat 513841
gtggaactgg agatcgtcat cggcccggtc agtggcaagg gtcgcctgtt cctcttctcg 513901
cctcttgatg gcttggtgcc gtttgcgttc cgcgcgctgg ccgaactgct tgcccagttg 513961
ccgcggcaac cgcgcgagct ttccccagag cttccggtga taattgcagg tgagatcggc 514021
acgcttcgag cttcggcggc gctccttcga aaagcatccg tcggtgatgc tctgttgcca 514081
gacatatcgc cgttcggccg tggccaaatc gctctgtctg tgggtcagtt atggaccagg

gcagaccttg agggcgacca cctagtcctg cggggaccct tccgcccgca atcacgcccc 514201
ttggagtgtg cgcatatgac agaaatcgaa tcgcaactaa ggccgtcgga tgccgatctc 514261
gatgacatcg agatcgtgct tgtctttgaa tgcggccgct ggcccatctc gttgggcgaa 514321
ttgaggagtg ccggcgatgg gcatgttttt gaacttgggc ggccaatcga tggccttgta 514381
gacatagttg ccaatggtcg gtgtatcgga cgtggcgaca tcgtgcgcat cggagatgat 514441
ctgggcatca gactccgtgg aaggttggca tgcaatgact gaaatgcagc cggcaattct 514501
ggcccttctt gcgataaccg cggcactcgg cttgctggtg ttagcggtcg tcacaaccac 514561
ggcatttgta aaagtatctg ttgttctatt cctcgtccgc aacgcactcg ggacccagac 514621
gataccacct aacatagtgc tgtacgcagc cgcacttatc ctcaccatgt tcgttagcgc 514681
acccgttgct gagcagacct atgatcggat aacagatccg agactccgtt atcaatcgct 514741
cgacgactgg gctgaagccg ccaaagcagg aagtcagccc ttgcttgaac atctcaagaa 514801
gttcacaaac gaagagcagc ggcgattttt cctctcctcg acggaaaagg tctggcctga 514861
ggaaatgcgc gctggagtta cagcagatga tttcgccatt cttgtaccat cttttctgat 514921
atcagaacta aagcgcgcgt tcgaaatcgg cttcctcctt tatctaccct ttatcgtcat 514981
tgatcttatc gtcacgacga tattgatggc catggggatg tcgatggtat ccccgacgat

Figure 3 (Cont.)

515041
tatagctgtc ccgttcaaac tattcttgtt cgtcgctatt gatggctggt caagattgat 515101
gcacggactt gtgctcagtt atacgatgcc gggagcttta tgatgaccgg atccagtatt 515161
gttagtctaa tgagccaatc attggtggtt ttcatgatct ggattctgcc cccgctcatt 515221
gcatcggtga ttgttggcct aaccattggc atcatccagg cagcaacgca gatccaggat 515281
gaaagcctgc cactcactgt gaagctcctg gtcgttgtcg cggtgattgg cctgtttgcg 515341
cctgtgctga gcgctccgct catcgagctc gcggaccaga tctttaccga gtttccagca 515401
atgacactcg gctattagtc tgcgctatgt atttgtcacc tgccgagatt cagatcttgc 515461
tccatgcggc tatcgaactc gttgcggcag ccggtcttgg agcggcccgc gcgctgggca 515521
taatgctgat ccttcctgta tttacacgat ctcaaattgg cgggctgatc cgcggctgcc 515581
tggctatcgc cttcggacta ccctgcttgg cacacgtcag cgacggattg caggcgccgg 515641
atccggaaac aagtctgatc cagatacccc ttctcggact aaaggaagtg tttgtcggcg 515701
tgctacttgg cacttttctc ggaattcctt tatggggcct tcaggcggcg ggtgagttta 515761
tcgacaacca gcgcggcatc accagcccgt ctactcaggc cgacccagca acgaacagtc 515821
aggcttccgc tatgggagta tttctcggaa tcactgcaat tacgatcttc gtcgcagcgg

Figure 3 (Cont.)

515881
gaggcgtgga agctgtgctg agcgccctct atggtagcta ctcaatctgg cccgtatatc 515941
ggtttcagcc aacattgagt acccaaggcg cagtggagtt attcgggctc ctcgaccaca 516001
tcatgcgcac gacattatta gtctcggggc ctgtagtgtt ctttttggga ctgattgata 516061
tatcaatgat gatgctacgt cgctttgcgc cacaattcaa atctggccag ctctccccgc 516121
cgatcaagaa tatcgtcttt ccgatcatca tggttaccta cgctacctat ttgctcgagg 516181
gcattaaact tgagatcacg caagcggacg gcacgcttgg gtggctcgac aagttgctga 516241
aatgagcgat acgagcgaag agaagtcaca cggcgctacc cctaagaagc tgagcgacgc 516301
gcgcaaaaga ggtcaaatac cgcgtagctc ggatttcgtc cgcgcggccg ccacttgcgc 516361
tgggcttggc tacttatggc taagaggtag cgttatcgaa gataaatgca gggaagcgct 516421
actattaacc gacaagctgc aaaacctgcc tttcaatctc gcggtccggc aggcgctggt 516481
tctgctagtc gaactcaccc tggcaaccgt tggcccgctg ctctcagctc tttttggcgc 516541
ggtaatcttg gctgcattac tggccaatag aggatttgta ttctctctcg agccaatgaa 516601
gcccaacttc gataaaatca atccttttca atggctgaag cgcttggggt cggcgcgttc 516661
ggcagtcgag gttggcaaaa cgctgttcaa ggtgttggtt ctcggcggga ccttttccct

cttctttctc ggtttatgga agacgatggt ctatctgccg gtctgcggaa tggggtgttt 516781
cggcgtcgtc tttaccggag cgaaacagct gatcggaatt ggcgccggcg cacttctgat 516841
cggcggactg atcgatctgc tgttgcagcg tgcgctattt ctgcgcgaaa tgcgcatgac 516901
gaagacggaa ataaagcgcg agttgaagga acagcaagga acgccagaat tgaagggtga 516961
acggcgtcgc attcgcaacg agatggctag cgagcctccg cttggtgtgc atcgcgccac 517021
gttagtctac agaggaactg cggtgctgat cggtctgcgt tacgttcgtg gtgagaccgg 517081
agttccgatc ttagtttgcc gcgccgaggg cgaggccgct tcagatatgt ttcgcgaggc 517141
gcagaatctg cgtctcaaga ttgtcgatga tcatgtccta gcgcaccaac tcatgagcac 517201
aacgaaactg ggcaccgcca tccccatgca atatttcgag cccatcgcga gagcactctt 517261
ggccgcaggt ttggcctgag catccctgaa ttcggaaaag aactttgaag acattgactt 517321
ccgggcgtga ttcctttggc tttaagtcgg gacgcaatgg atggcccagg aagaaacagt 517381
gctgccgcaa gcacatcgca cggcgggatc atctggcaat cggtttctgc gaatggcggc 517441
aaacgtggct cgcgcttgtc gttcaggttt ggcatgtccg ccggtggcga cacgttgttt 517501
caaatggtag ttgtggctga gaatcgatag aggtgccgca cgtgttgggg tcggacgtaa 517561
cggcggccgc agggacgctg gtccggcgcc cccgccatat ccgtgcgtgc agagttcccg

Figure 3 (Cont.)

517621
cgtcatgacc cgtgcccggg ctaaagcaac agggtcgtag atttcgaatg acaacacgtc 517681
tgtggcggac attgctcgtc gccacgagat cgatcggtca ttttttctac agatggcgtc 517741
aaatgctgcg aacctctgcg ataacgtcga cgcttcagca aattggaaac gcggcggcgc 517801
aaacagttgg cttaagccca aacttccacg acacgtccgt tccagccaga tctgccaccc 517861
aagccgataa tggttcaatg gttccgagct ccggccgtcc gcgcaagcag caacagagcc 517921
agtgaacccg agtatcggca aatagcggca gaaagctttt tgtccgcgct gaaagtccca 517981
ctagtcagct gaacgtcagt tgtgcgcgtc tatcatcttg acccgttttc cctaccagtc 518041
gctctcagtg caaaaaaata ggagtacaag atcaccatgt acggtcgaat tgatagctcg 518101
tccgatttcc attacacgca gagtgccagc aagcaaatgg atgcagaaac ccaagagttc 518161
gcggacacgt ttgcccgaat gcacttagac aggtccaacg gcggttcatc gtcggcggcc 518221
agatataccc tcgatcacga acctccggtg gtgccgattg atctcgagac tttcaggagg 518281
gagatcagga aatttcatgg caaagaaatc actgacatcg ccaacaatcc acaggaatat 518341
tcagacttcg tgtccgcaaa agccagacgc actgcggacg ttgctcagca atacggcatt 518401
cgtcgggatt ctgagaacgc tcgatatttc agttaccagt tgggaaacca gtgtgttgga

Figure 3 (Cont.)

518461
ctgatgagaa cggaaggtgg gttcagcatg gaagaagagt tcgaatccaa aagttggaga 518521
gaccaatttc ctggtcacca agagattacc tccaccgtgg atcttcaagt cgcccatcct 518581
ctcgttgaga atgcaggcga tattctgctc gagcaccaac ttcggaggga cggcgaacga 518641
ccgttgctga actggcgcgc ggaaaaccca gaggcgaaag cccgtgcagc gatgatgggg 518701
tttgttgaag tggatgattg cgacatggtc cttgacccca aacagcatcc cgacaaatgg 518761
acgcagacca gtgccgctga atggcggcgt aaagacaaac cgccgctcta tctccgcaaa 518821
tttgaggatg ccgaaaccgc acagtgttca accagctgct cttacgagac ttacgaagat 518881
gacttcatgt gaccggattc tcgccagatt tggtcgcgac ggccggcccc atctgccaag 518941
accggccctc atgtcacgga cagggaacga aagagcgtta caaactgcca cgcgctaacg 519001
agcgataccc attcggtgtt taggcgcaaa ggggcttgaa cgcagggttt ctttgagacc 519061
atcgtagtag ttcgttcggg gttttgcacc cgagtcccgt aaaacacctc gaggccgttc 519121
tttacattga ggccggagcg tctttgatgc ccggcctctt ttgccatcgg gtggctccga 519181
caccgcaatg gcgatacgca aagcagttgg tctcgccggc ccgaagtttc gtgtaaagca 519241
agcctttgcg cattcgaggc ttcatcgaac ctgagagagc ttcacgctcg cgcaaaatgc

cgaatttctc gccctgctgg tccaactgca cacgttagcg ttttttgtc ctggagccga 519361
ccggcttttc gaacaggttg tcgcttgctg tcggctgccc gttgtatgct atgtcactca 519421
agtgcatcgg actgagcgcc gcctcggcct gccggagttc cagggagtcc agatcgtgca 519481
gcacgtttat atgcaatagc gcttcttttt ttgacaattg tcagcttttc gaaagctgga 519541
gctcataagt agatgttatc tacaattcgc cgctaaggca ggagtagctg atggtcggag 519601
tgattggaag tggagttggc tccatcggcg tttccctggc ccgcaaaggg gggcatggac 519661
attcgactgg acagccgccg cgcgattcag gcgggccctc tggtcacaac aggccggatc 519721
gcgggagcgg cgttacggat ggcccgacca tttctgggga tcgctcgcag gctgcaattc 519781
aaagcgaagc cttcgaacta gctcttcgat cggttgcgct acaacttatg aacgatgcca 519841
tggctgatgc cgacgaagct atggcagaaa ctgaagagga tgcctgacgc tgggtggccc 519901
ccgtcaggag gtgcgtgccg ttagtgacgg cacaattgta acagaaaggg aaatgacatg 519961
tctaaaatag gtactctcac gagtgcagtt ggagctggcg ccgcggctgg ccagaacgta 520021
gcggccaaag gtgctggggc tgcggccttc caggcccaaa tcgcagaact ggcagcggtg 520081
agcgcagagg ctacggctag gagtatgcta ctgcgcactg ttacgaccga gctccagaca 520141
accaagaagg cggcggatga acgcgtacag tgatgcggat ggggctctag gcactgcgta

Figure 3 (Cont.)

520201
gcacaattgg cacgaagtgg agccgagatg agccgcatgc cactcgccgt gcggcttctc 520261
ttttgtctgg atatcgtcag tgaacgacgc catttcgctt caattcaaag ttatctcagg 520321
gctctattgt gaactgactg gtacgacggc tctagaaacg agcttgatcg gtagcggcct 520381
cgacgccgac atagtgttcg tcgagcaggg cctcgcgccg catcattttc gcgtcactct 520441
tctgggcaaa acacttgagg tcgaggcgct tgctgccggt ctcagcatag agggaaacgg 520501
gaatattgcc gcaggcgagc gggttgtcgc gccccttcct gtcgtcattc atgcaggcgc 520561
gatgtccatt ctctggtcag tgcaggatgc agcgtcgtct ggttcgatcg gtaaaccacg 520621
cctctcgata tctgtgctcg ccttggtgtt gctcggttct ctcgggatcg gcgtgctctc 520681
ggccattttc tcttactacg acaacgctgt tgtatcgaac gccgatttat ctggtgaggc 520741
ccgggaaccc aagctgcctg ataatcgcac tgatgatgag actgcattca cagccgctaa 520801
agccctgcaa caggaagtcg acagagccgg tctgtccaac attaagatca gcgccgctga 520861
gggtgttgtg acagtcgaag gcacggtcac gtctgcttcg gccatcagtt ggcataaagt 520921
gcagcagtgg ttcgatcatc ggacgagggg cgctctagcg ctgttgaatg gagtgattat 520981
cgacgatgag aaggcgccat ccgcaatcgc agtcgaagct gtctggcgtg ggtcgcttcc

Figure 3 (Cont.)

521041
gtatcttgtc atcaaaggag agaaatattt cgtcggcgct cttttggatg atggttggat 521101
ggtcgaacgg atcgaggacg gtcgtgtaat gctaagccga aatggccgcc ttgctgctgt 521161
cccgtattaa agtattccag cgcagggctg acgatcttgg acagacttga tgaccggtca 521221
acttcgcact tgcctttgaa tcttatgcgc agccatccgc cgcaggggtc ggcctcacgg 521281
acgacgcgcc tgcggtctta gagctacgtt gcacctgtgt agcagcagag tggttcagaa 521341
acgatcgtga agggacctca tggccaacgc cctgcgtaga ttcaccgagt atgcgccggc 521401
caatccggac ttgatggtcg cgttgatgct gcttctggcc gtcagcatga tggtcatgcc 521461
aataccggtc atggcggtcg atgcgctgat aggcttcaac atgggtttgg ctgtactgct 521521
gctgatggcg gccctgtatg tcagcacgcc acttgatttt tcctctttgc ccggcgtcat 521581
tttgctttcc acggtattcc gtctggcgct caccgtcgcg acgacgcgac taattctggc 521641
cgagggcgag gcaggcagca tcatccacac gttcggcagt tttgtgatct caggcaatat 521701
tgtcgtgggt ttcgttatat ttctggtagt gaccatggtg cagttcatgg ttctcgcgaa 521761
aggcgccgaa cgcgtggcag aagtggcggc gcgcttcacc ctcgatgctt tgccaggcaa 521821
gcaaatggcg atcgacgcag agttgcggaa cggtcacatc gatgccgacg aatcccgcag

gcggcgcgcc gcattagaaa aagaaagcaa actttatggg gcgatggacg gcgcgatgaa 521941
gtttgtgaag ggtgattcca tcgccgggct agtggttatc tgcatcaaca tgctgggtgg 522001
aatttccatc ggcctgctct cgaagggcat gtcgttcgcc caggtgctgc atcactacac 522061
tctgctgacg ataggtgatg cgttaatctc gcagattccc gccctgctgc tctcaattac 522121
agcggcaacc atggttactc gtgtaactgg ggcttcgaaa ctcaacctcg gtgaggacat 522181
agccaatcaa ctcaccgcca gtacacgagc attgcggttg gcggcctgcg tcctggtggc 522241
catgggcttc gttcctggtt tccctctgcc tgtctttttt atgttggccg cagtcttcgc 522301
ggcggcaagc ttcgtcaaag gtgacgtcct agatgccgac aaagtcgatg ctacaactgt 522361
aactccggcg gagtctcaaa cgccaaacgt ggctgcgcag ccaaatccca ttggcgtctt 522421
cctcgcgccg agccttacga atgcgatcga ccaggtcgaa ttgcggcagc acattgcgcg 522481
tatttcccaa ctagtctcgg ccgatctcgg cattatcgtt cctccgatcc cagtcgatgt 522541
cgaccagcag ctgcccgagt cgcaattcag gatagatgtc gaaggcgtgc cagtcgaaca 522601
ggatttgatt aatccggcgc agctgtccct cgcagacgat ctgaagaaga ttgagtcaag 522661
cggcatccct tttcggcatg atcctgaaac ccacagaatt tgggttgaac aaagccacga 522721
gccggcgctc aaagccgccg gtatccggca tcatagtccc agcgaactcc ttgcgatgcg

Figure 3 (Cont.)

522781
tgtccatgcg acgttgactt gccatgcgcc gcgcttggtg ggtatccaag agacccgcca 522841
actactgggc cggatggagc aggaatactc tgatctggtg aaggaggtgc tgcgtaccac 522901
gccgatcccc cggattgcag atgtgctgcg ccgcctcttg ggcgaaggta taccaatccg 522961
aaatacccgg ctcgtcttgg aggcattggc cgaatggagc gaacgtgagc aaaacgtcgc 523021
cctgctcacg gaacacgttc gttctggaat gaagcggcag atctgtcacc gctatggcag 523081
acacggtgtc ctacctgcct tcgtcatgga acgtgagact gaggatgtgg tgcgctgcgc 523141
ggttcgggaa acggctgcag gcccctacct cgcactagag gatcggcaaa gcgaggcgct 523201
gctgtcacag atgcggcagg tcttttcgag cacggcaccg ggccagacgc gcccgatcgt 523261
cttaacttca atggatgtcc gacgcttcgt ccgcggtttt cttacccgaa acggtatcga 523321
gcttgccgta ctgtcttatc aggacctcgc ctccgatttt aaaattcaac ccgtcggatc 523381
catcaggctc ccgcccagta atggaacgtc aggggaacct cgcagtatcc gcccttctgc 523441
cactactgga tgataggtga gaaccaaaca tgaattcaca tgagaataga gtcgccgcgc 523501
cgttgctttc atttcgtttg agcttagttc tcttcgcagt actctccgtt ctgcctctcg 523561
gcggttgtgc taggtgggat aaccccgttc tttcagtgaa ggagacgtca gccgcacaat

Figure 3 (Cont.)

523621
tgctcggcgc caaccaaatc aatgcggcta cgcgccaacg cattttgcgc gccgtcggtg 523681
aggacgctca agagcgggct ttgcgggatg atctgaagca gcatccaggc aatgtcgatg 523741
cggcaatccg tcttacaaaa gcattggtgg cgcagaaacg tccgcatgag gcgcttcagg 523801
ttttagacaa cgtcttggtc gtgaccccag acaatttgcg tgcattgaat gcgaaggcag 523861
tcatcttgga cattgagggg cggcatgacg cggcacaaga gctgtaccgg caagctctcg 523921
aaaccaaccc agagaatcag atgttgcacc ataacctcca tctgtctctt gcgtttgaag 523981
ggaagtccga acagaggact ttgccacaat cgcgataacg ttgctgtgat gaattcacct 524041
ttgagaagca gacgcagcac gtcgtgcgtg cctggggacg aggcaggccc tatagcaatt 524101
gagcgctgaa cacgacatta aagggacgga actgagcggc taatcctatt ttctgacagc 524161
ggctctggtt tgaattggcg ctgtgtccgt ggcgctcgac accgagggcg cggccggcgc 524221
gcggcgtaca gcgttttgtc ggtccggtta ttgaccttgc ccgcatccgc ctatctcagg 524281
gtcgcgttac cgctgaactc actgccgttg tcctgacgat catcatcggt tcgctgcgct 524341
ccaggataaa tcccagccga gctcacgggt gcaacacgca ggccagggcc attataagag 524401
tagtgcgtaa agggggctca tcaaatggag ccaatttggt tccctaggcg attaaacagc

atgcggcatc aaaagtgtca ccctacagaa tatttatagc attaatattg ccccatagtg 524521
ttgcttctgc gtaaccgtat ttaacatagg gtcaagtgcg tgatgcctat acgcggacaa 524581
aacgaaacta ttccctcaaa taagcagaag gatgtcgaca agaccttgaa caaacttggt 524641
acgaagtttt ctggcacgcg tgataagcac ctaggatacc cgtacaacct cgactttgac 524701
cacagaccaa tctctcaatc ccacaaattt ctaaataaca tgggtgccat atgtcggctc 524761
acactatgcg accgaggtct gtgactagag tgcgaggtgg tcgactggac catgcgggtc 524821
ggggagtgcg ctgatccaga agaatactgg ggaactgtgg gcgcaagtga aactgaaggt 524881
aatcgatggc catatacctt gcgcgcgaga cccttgataa tcctattctt atacactcga 524941
cagagggtag tgtgctgaag gttctgcaga attctctgag aggggcggtt atggcagcct 525001
ggtgatgacg aacgtggatc atgacgtgct gatcgcaacg ctcgaccggc tgaagctgac 525061
ggcgatcccc gaccagctcg acacgttgct ggacgaggca gcgcgttcgc gagcgtatcg 525121
aaagaacgat caggcttggg tcgagcagaa gaacggcgcg atcgtgcgac ggctggtcgg 525181
ttacggaagg ctcgtcggcg cggaggcgac ggttgtgctt gggcggctct acgacgtggt 525241
gcgtctgtac ggcaatctgt tccagccttc gttcaagctg cgagagaaga cacggatcgg 525301
cgcccgcgtc gtcaaacgct accatccgcc cgtgccgcct atcgcgcggg tggttgccca

Figure 3 (Cont.)

525361
ttccggtgtg gccgaggccg ataaggagcg gctgcaggcg atgttggaaa gggaagatcc 525421
ggtgatgctg tttgccggaa ttcgtgccgc acaggaggag ctcggaaagc gggtcgatcg 525481
ccgtggcttg aatgccggga ccgaagaacc gctcgccatc gatctgcagc gattcaccgt 525541
gagcttgaag acagcctggc aggctggaga gaaacggccg acacatcggc ggccctatcg 525601
gcgaaccaag ccttacccga aaaggccgag catgctggag ccattcgagc cccagattcg 525661
agcgtggctt gaggcagatc cggcgctctc ggcagcccgc ggtgctccag cgccttgtga 525721
gcgccgatcc gtcacgcttc accaagaaag cgctgcggac ggtgcaaatg gccgtcaagg 525781
cttggcgcat ggaaatagcc gggcagatca tactcgatgg caactggatg aagcgcgcgc 525841
ccgtatctcc tcccgccgcg gcgcagggct gtccggggaa agttgcggct gaatcgaaat 525901
gtcgcaggcg catgccccgt cagacgggga ttttccgtct accttctggt tgtcgagact 525961
cagaaagagg acggggcatg cggttcacac gtagcattct tggcaagctg attgaaccgg 526021
tcaatcggcg ccgcttccag acgatagtgg atgatcacga cggggacgcc tacgacaagg 526081
cgttccgcag ctgggactgc tggtgctgat ctatgcccag ttgagcggtg cggagagcct 526141
gcgcggcctg gaggccggct ggaacgccaa cagccatcac cactatcacc tgggcagcga

Figure 3 (Cont.)

526201
ccgcttgccg atgccaacgc ccgccgcccg gttgccgtct ttgccgagac cttcggcctg 526261
cttgccggcc aactcgaccg acagacgcgc cgcgagggcc gggccatgct gcggctgatc 526321
gattccaccc cgatcccgct cggcaagctg tgcggctggg ccaagtcgaa cggccgcatc 526381
cgcggcatga agatgcatgt cgtctatgac cccgacagcg actgcccgcg cctcctcgac 526441
atcaccgatg ccaacgtcaa cgacgcccag atcggtcgca ccatcgccat cgagagcggc 526501
gccacctata tcttcgacaa gggctattgc cactacggct ggtggacggc gatcgccgag 526561
gcgaaggcgt tcttcgtgac ccggccgaag tccaacatgg gcctcaaggt ggtgcgccaa 526621
cggcgcatca aggtcgccga gggcgacggc ttcaccgtca tcgacgacgc caccgtgcgc 526681
ctggccagca agggtgattc caagctgccg atcccgttgc gccgcctcac cgtcaagcgc 526741
gccgacggcg acaccatcac gctgctgacc aatgatcgca agcggcccgc cgtggccatc 526801
gcggcgctct acaaaggccg ctggcagatc gaactcctgt tccgctggat caagcagcac 526861
ctcaagatcc gcagtttcct tggcaacaac gacaacgccg tgcgcctgca gctcttcgcc 526921
gcgatgatcg cctatgcgct actgcgcatc gcggcgcgcc ttaaccgcat caccatgccg 526981
atcctgcgct tcaccgactt ggttatccgc tgcctcttcg agcgccgcga catcgccgcc

atcgagcggc cgccaccggt caatcccagc cacaggagac cccggtgctc cccccatcaa 527101
atgagcttcg cctatgtctg aatttccccg gacagccctg cgccgcggcg ggaggatata 527161
cgggccatct cagtgccccc aacttcagta acattcctgg atgaggcaat agggggggtc 527221
aattctccga ttcgcttgac atgccggctc tatctccccc gatgctctct cagaggttat 527281
tcacgcaaat cgccatcgca ccgtcattct cgcattgacc tgtggaccga ccatgaaagg 527341
gggcgcacga cgatatcgcg tcctgcatca aggttctgga ccaagtcggg atcgatccga 527401
accgacgctt tgtccacgtc gagggcgcgc tgaatgcaat ggtacttccc tttgtcgatg 527461
gcttacagag gggcatccgc ccttctttcc gccgtcagct acctgcgcag atgatgcgac 527521
cccgatggga tcgcgaaacg gccacgccgt tctcgcgatt tggaacgggc gcatgcgcct 527581
tgacatcgct ggtttccgca acaatcttcg tgcctgcatc gaacgcgcgg agggcttcgc 527641
agcagcactt cgctcagtgg gcgtcttggt attgctcaat ccgtggtcat tgacggttgt 527701
gtttccaaaa caatcgggga ggctcgtcaa cgaatatcaa cacgcatgca atggaggttc 527761
tgcccacgcg atcgtcagcc aagcgtcaaa gcagatctca tctatgatca tggccttcct 527821
tggaggcagc ttcctgattg ctggtgacgg cctgacgacc ggaagcattg tcgcgtcagc 527881
ctcgctcttg tcgccggcct aggttacgcc agctttatct tcgcatggaa gcttttccgc

Figure 3 (Cont.)

527941
gctcttcgca gccgtgttct tcggggaatg gctaacaggt ccagagtgtc tgcggcactg 528001
gctatcgtcg ttggtgcgtt gatcacttcc atgcctgagc gccgtgtcgc cttggatgtt 528061
tctatgcggg cgtttatatg gcgctgcttt ttgtggtggt tgacctgcga gagcatcggc 528121
ccgagccgcc gcactacaat agaaaacctg tcgccggggg atagtgaatg tgcgcggcgg 528181
actacggtag gtcagccgcc gttgcaccgt gcctggtgcg tgcgggcggt cggccctcag 528241
caggcgctcg gcccgtaatc gggcctcgcc accgccggca tgccgtggct cgggtcctcc 528301
ctgcgcttac acggacccct gggcacgaat atcaggagca gggcttccgg cccggggcag 528361
gggagtaggg aatcgcattt gactattttg gttgcatttg gagggccggg ggattcttga 528421
gataggcagt tcgtggagca gaaaccgcca ttccttatct tgaaagctgt ttcggggcgt 528481
ctccatgcaa ataggcccaa ttggcgaagg ggagtagggc accggtcgat ccttctcccg 528541
acgaactgct caagcacgtc tcgctgctca gttcggagca catcagtcgc gatcgtcgca 528601
agcagcggat ggtgccgccc cggcgcgagt gggcttgaat gcctgaagaa agactccagc 528661
gagcttacgg acgtatgcat gttgctcggt cgccatcacc gataagttcc ctttctccac 528721
aatcgcctcg agactgggct tgatctgcag ctgccgaatc cagccgactt tcgatcgcat

Figure 3 (Cont.)

528781
cttcatcggc atcattggca gcctggaggg ccaaaatcgt gtggcggaac agtcgcagcg 528841
ctccccgatc ccgctcaggg tttcaacatc attctcggtc aggagcgcgg caccaggaga 528901
tcgccaagaa ttgagcttct acagcgggtc ggctatcgcc aagcgcgggc catttttgag 528961
gcagcctaca ccgttgccgg catagctgaa gcttaaagaa accgatgcac ctcgcgaggt 529021
gagcaacgga ccgtaagttc gccgtcagct taacgaagca tcgtgcgaag cgcggtctaa 529081
gcggccccat attggcaata accgtgcgaa gggaaacgaa cgccatgcac agtcccatca 529141
gtggttcatt cacaagctct acgcaagttc acgatccgat tcatccagcg aacagcgatg 529201
gtttcaggga gacgcttgcg aatgttgaac tccggacgaa atcaccaagt gcggagtgcc 529261
ccgataagat ggggtgctgc gccagcaagc cacaagcatc tgatccgaac aatcccagta 529321
cctcctctcc tgcgagaccg agcacctccc tgttccgata caggacggcc gaattggccc 529381
aggcgaacgc agatggaatc tgcgtcggct tgactgcgga gtggctgcgt aacctcaaca 529441
gtcatccgtc aatccgaatg gaggccctag tacccggatc gcaaaggcac gcctcagcca 529501
ctgttcggca gaaggagtac gagaatctga aggttcacct ccgaagacaa ggagcaggac 529561
cttctgaggc cgacttcgcg gcgcaaaaca ctatgttgca gaaagcaggc cttgctccat

ccggaaagga gaaagtatac aaagtcggcg agcctaactt cccgcgcatg ctaaccaaga 529681
ttacagccga cggatccaac catttgctca gcttgtattt cgctgagggc ggcgcacaca 529741
ccgttgcgac ctcggcaatg gatggaaaca ccacgctctt cgatcctaat ttcggcgaat 529801
ttactgtgca atcagatcag atagatgatt tgttccgaag cctagccaat cgctacagca 529861
atccaaaccg gcagcattta acaacggtga ccacccaaaa gatgacatga gtcgggcgtc 529921
ctgcgcggcg tagtgttcac tgaagtccac gtaaatcctc gtcgatgctt gtgctgaaga 529981
ggtgggattt tggtacgctg agcagcaata gctgctgcgt gcggggcagg aattggacga 530041
cgcgccggcg gaccaggtgg gtttgagcag cagctggcca tctgcagctc agcttatcgg 530101
agaactccgc cgagccgatt tcgcccgaca ctggttcggt agaggtgcat ggaggtattc 530161
agcgcattag cctccgcggt tcgatgctga tgccgccgca atccaactgg caggacaatc 530221
ggttcagcag tgtcgcggca caggtcgacg ttcctcgcgc ccacattcgc ggtcatgcaa 530281
ggttctccat ctgacttgcg caacaggact tttcgacatt ccagccgatg aagacagctt 530341
tgcagcgcga caaccaagat gagacgccag cggcaagcac gaccaggtcg tcgattatcg 530401
gcatgtcatc cattcgctgc gcaaaaagcc gatggcgctc cttcagcttg tctatcgcga 530461
caagctgttt ccgcggcagg aataccgaag ggccttcgag accctgctcg accggctttc

Figure 3 (Cont.)

530521
cgacaagcag gcctgcaaga tcaccgtcga gctcttggcc ttggcccacg atcggggctg 530581
cgagcgggaa ctggcagagc ggctcgctaa aacactcgat gcggacgaac tgccggacat 530641
catcgcgctg aggactttct tcgcgcccga tccggcacag ttgcccaccg tcaacgttcg 530701
tctcgcctcc ctccagggct atgaggccct gatcgacgcg cgtcatctgg aggacgccgc 530761
atgaaaaacg cccctgccat cgacgccgcc acgctcagca cgctgcgcaa tgaactccgc 530821
cttccggcca tcaaggtcct ttggccggac tttgccgaac gggccgacaa ggaggggtgg 530881
ccagcggccc ggttcctgtc ggtgatcgcc gagcacgaac tggccgaacg cgatcgccgc 530941
cgcatcgaac gccatctcgc cgaggcgcga ttgccaccgg gaaagacgct cgacagcttt 531001
gacttcgacg ccgtgccgat ggtctccaag gcacaggtca tggcgatcgc cgccgggcga 531061
tagctggctc gccaagggag cgaacatcct gttgttcggc ccgcccggtg gcggcaagag 531121
ccatctcgcc gccgcaatcg gcctcgcgct catcgagaac ggttggcggg tgctgttcat 531181
gcgtacgacc gagctcgttc agaagctgca ggtggcacgt cgtgaactcc agctcgaatc 531241
cgccatcgcc acgaagccca accgacatgg acagtcgcgc tgcgctgcgg gcagcgatcg 531301
agacagcttc aacgacagac cagggtcaac gatcgcaaaa acaatcagtg ctacgtaccg

Figure 3 (Cont.)

531361
ggtacgccgg gccctgctgc caatggcaac cgtgatcgaa cgcatgggtt gtcggcccgc 531421
gccattgccc ggcgtcgtgc ctaggcagct ctgatcggag ctgacgctta cgcgctcgag 531481
atcgatcctc gcttgcaggc cccgcatccg gtctgggggg tgggacatcc gggagggtga 531541
cgccacttag cctggctcgc tggtgacttc aacgccagcc gtcggtacgc gacagtcata 531601
acgcaggcat caaactccgc cagaagctca ctgatgacgc ggcagacgat gttcatcaag 531661
ccaatcggct gcctgctctc gcaggtcaac aaccgcaaaa tgcagcgcca tatgaacgct 531721
cgcatagaaa catctaaggc gctgtgactg ttcctcgccg cgatttttgg cccctgcagg 531781
ctgccaatga cgccgatgaa gatgcgatcg ggactataga ccggaaagtc gctgacaccg 531841
gctgctgcag atcaagcccg gtcttgaggg gatggtggag aaaggggagg tatcgcctct 531901
ggtgatagcg accagcaacg agcacacgtt cgtaagctcg cgggaggctt ccttccaggc 531961
gttcacgttc gactcgcccc gggggctata gacgaacacc ttatgcccaa gcccgactga 532021
gtgagcatgt tacatgttca tccacggtat ggatgatagc tatgcaaaaa ctcgattttt 532081
ccattctcgc gaaattcgat taagaaactc gtacaggttg gaggcagagt ggacagtcag 532141
acaccggcca cgcagatatg attggcaatc cgtccgcgga tgcattgagg caggcttcat

gagcgaattc aagtggggtc acattcgcgg cgatctgaat tctcggctcc ccagctatag 532261
ccgcaggcag cgcaatctcg ggtgctcacc cgtacgtgcg tgccctccag tacatcacaa 532321
gccctcgctt ggtttagctc ggtgcgacgg aaatcgacag gcgccgccgc cgagggtgct 532381
gaattggcgc aactggcaga ttcatgaggc acttgtttga aagcaaagct cggtcgatct 532441
attggccgct tcggcgacga gcggggcaac atagctgttc tttgctttac aacggcagcg 532501
caacgccgaa cccgccaagc gttttttgag gagacctgct ccggcttgag ttcggaagac 532561
acttcccgag acactgcatc gccaggtaac gcatctcatc ggctccgttg aagctcagtt 532621
tatcgcgggt gccatcttgt ggcccacaaa caccacttac gaggagaaga catcaatgga 532681
tcagcccgct tggaagaatc cgcgtacggc cctgatcgtc gatggcagtg acgctgcacg 532741
tcaacggcgt ataccgaatc tggcgtcggt cgacctaaac ctgctagtgg agctcgaggc 532801
cttattgcag tatcgaaaca tcacgcatgc ggctcaacat gtcggtagga gccaaccggc 532861
aatgagtaga gccctatcaa ggctgcgtga catgttcaat gacgatctct tggtacgcgg 532921
ctcgagtggc ctagtcccaa caccgcaggc cgaacacttg gcgcaaatgc tgccgtcggt 532981
attgaatgct atccgcgaac tggtgagctg cagttccggc ttaagggatt tgcggtcgaa 533041
ggtaactatg gcaatgcccg atcaccaatc gctagttctg ctgccatatc tattgccgcg

Figure 3 (Cont.)

533101
tttaggtgag cgtgtgcctc atgttgacat cgtcaccgag ccacttttgg acggcgctct 533161
acggcgtctc gagcaaggtg agattgactt tgcgatcggg cagattggtg ccgctcctcc 533221
aggctacttg cggcgcggtc tctatgcgga ccgcttcact tgcctgcttc gccacgacca 533281
ccctgcatta gagcaggagt ggagcgtcgg aaccttcgcg gcgctgcgtc acgcctctat 533341
tgcctcggat tccaacgagg gcctgggtca agtctatgat gggctggtca ggttcggact 533401
acccggtccg atagtggtct ccaacgtgct gactgcggca gttgtagtgg cgatgactga 533461
cctagtgctg atgataccga accgagttgc aactcgggtg gcgactatgc tgccgctcgc 533521
tattgtagat ccacccgtgg agctgaagcc atacgaagtt gcgttgatct ggcaccagcg 533581
ctgccatcat gacttggaac atcgcgtgct gcgtcgcgaa atcgccgccg cagcgcggat 533641
gggccggcta gacgtgtcac aagaccaaag ggcgaggcgg cagaacgata gttgaactca 533701
ccgctgaacg gaagggtgca gcgaaggaca gcccgacacc gcgtgcgatt gatcccatca 533761
agcgccgggt gtttgacgct ttagcttcct caaggcatca gttcatctcg gggttctcgc 533821
tgccatgtca tcgcactcgc cgtggacgct ggcgccactc tgctaagtgc cgctttgcat 533881
cgtcaacatt tgacctatat tgcactgcaa caatggtagg cttgcctgat ccaccattat

Figure 3 (Cont.)

533941
ggtcacaggt tcccttcaag cgggaacgcg cgctcgctgc gcacgataga aggagttcca 534001
tctcatgaaa aatttaatcc acaacgtggg cccaaacgac gcccgtaggg accacgtcga 534061
tataggtgat gcggttcggc gatctcgcga agcggtcgga tatagcgtcg acgacctcgc 534121
attaacatgc ggtctgacat gcgccgaaat ttcaaggatc gaattaggtg ctgatgtcga 534181
ccctgaacgg ctcaggcgtg tagtcgctgc ccttcgagtg ccagccacca ccttcgcatt 534241
gaaacattca tgaacagcat tcagtggaaa caagctccgc aagctcgagt atagtccccg 534301
acgcgattgc cacctatgcc gacaccctca tttcaatagg tggcgtacag tcgaaccaca 534361
cgcggagtgt cgctgcggtt gcagcgaaga ccggcatgaa atgcctcctg gttcagaaca 534421
gttgtgccat cggccgtgat acacgacccg gcgcttctgc attcctatgc acatcaatcc 534481
agccgagaac atctcggtat ctgtgcgaga acgacttcac catctgcgtc ggcggcgaaa 534541
tcatcgataa atcagtcagg cctggaacct cttcgtcaac aacaaagtgc ttcgtcacct 534601
ccataaagtc aggcaaatgg gcgcaggtga aaacttaaat gcaatcgagt cgacattcac 534661
cctcacgagt tctcctaacg accaaactct tctcatcaaa cgttcgtgct cctcaagttc 534721
cggtaccgtg ctaatgccca gagcggaaag aacttggagt agccgtgata tcgcaaataa

aacacccgcg gaaaacccgt ggcggtgtag cgctgctcat cccacagacc gttctcggtt 534841
tgtgcgtttt ttaggtagtt caccccgcgt gcgacggccg gatgctccac ctcgccggcc 534901
gccatcagtc caagcaaggc ccacgccgtt tgggaggacg tggaaggcgc ctgctcatat 534961
ccgctatagt cgagtcggta gctgattgca tcctcgcccc aaccgccgtc ccaactctgg 535021
atggatacta gccattccac cgccttcctt atcatggggt cttggtgatc gatccctgcg 535081
gcattcagcg cgcacaacac cgaccaggta ccgtagatgt agttcaggcc ccagcggccg 535141
taccatgatc cttccgcgtg ttgggtgcgg cgcaaatatg caatcccctc ggcgactgcc 535201
ttgctccttt gggtgaattc gccgacctgg gccaacatcg agacgcaccg tgcggtaacg 535261
tcttcggtcg gcgggtcgag cagcgcgcca tggtccgcga atgggaggtt attcaggtag 535321
tattcgagat tgttgacgtc gaaggcggcc cagccgccat cccggctttg catgccttcg 535381
atccattccc ggccacgtgc gatcgcggtg gcgtattcct tgctgccggc gtgccgctgc 535441
gcgcggtcca tggccatgac caccactgca gtgtcatcga gatcgggata gtgcgcgttg 535501
ttgtattgaa acggccagcc gccgggcctg atgttgggcg ccttcactgc ccagtcgccc 535561
ttcacgtcca gtacctgccg cggcttcagc cagtccaggc cctgcttcgc tttcgccacg 535621
gcgttagcgc cgcccacctc ctgaagtgcg tggcacgtca gcgcggtgtc ccagaccggc

Figure 3 (Cont.)

535681
gacaggcagg gctggcaata ggcctcttcc tcgccgatca ccaagagctt gtcaatagcg 535741
cgacgtgcta tcgcgcgcgg cggaaaatga tcgtctttac cgagcgcgtc atacatcatc 535801
acgatattgg ccatcgacgg atagatcgcg cccatgccat cttcaccgtt gagccgctct 535861
tcagtgaagg cgagcgcact cgcgatcgcg cgctcacgaa gtttcttcgg aagatgcggc 535921
tcaataaccc gcaggatgcc gtcgatgccg cggaacagca agaaccagcc ccagctctgg 535981
tgcggcgcct tcgggttcat gcctacgctc ttggtatcct gaaggaacag ttcttcgatg 536041
ccgacgccct taggattctt cgcacgcggc ttcagcactg caagaaccat cagcggcaca 536101
atagtggtgc gcgcccagta ggagatcttg tagaggtgga acggcgacca gattggcagt 536161
agcac

FIG. 4

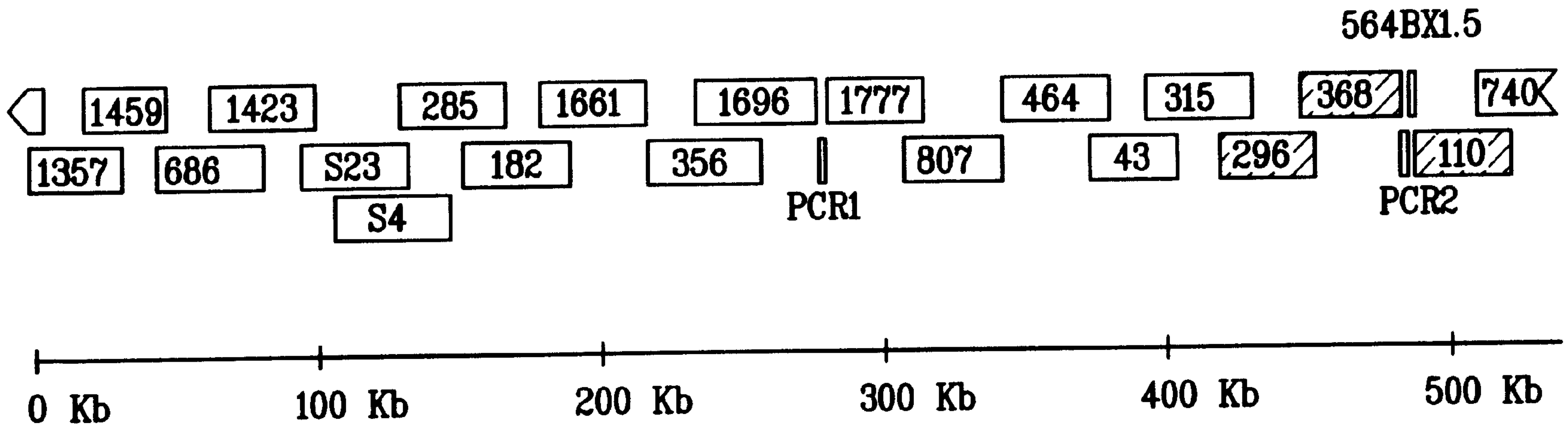

Map of the 20 sequenced cosmids covering the 536-Kb symbiotic plasmid of *Rhizobium* sp. NGR234.
The cosmid names consist of the prefix pXB and numbers that are given in the graphic.
PCR1:PCR product covering the gap between two cosmids from position 276,448 to 277,944.
564BX1.5 and PCR2: a subcloned 1.5-Kb DNA-fragment derived from cosmid pXB564 and a PCR product covering the gap between two cosmids from pos. 408,607 to 483,991.
Grey coloured areas cover the region from pos 417,796 to 517,279 mentioned in the text.

FIG. 5

```
                            10                  20                30
pRiA4b     C G C A A A A G A A A A G A G C C C C C T C A A C G T C G C C
pNGR234a   C G C A A A A G A A A A A G G C C C C C A G A C G G T A A C C
pTiB6S3    C G C A A A A G A A A A A G G C C C C C G A A A C G - - G C G
pRL8JI     C G C A A A - G A A A A A G C C C T C C G A A A C G G T G - G

                     40                  50                  60
pRiA4b     G T C G C G G A A G C C C T T C T G T C - T C - T C T A G C -
pNGR234a   A T C G T G G A A G C C - - T C T C T C A T C G T T T A G C A
pTiB6S3    T T C - C G G A A G A C C T T C T C T - A T A G T C T C G C A
pRL8JI     T T C - C A G A A G G C C - T C T C T C A - - G T T T G G T C

                   70                  80                  90
pRiA4b     G C G A A C A G A A T C G C A T T T C C T C G A A T C C T C G
pNGR234a   G C C T G - A G A A T C G C A T T T C C A C G A A T C G C A G
pTiB6S3    G C T A A G A G A A T C G C A T T T T C A G G A A T C C C A G
pRL8JI     G C T T A G A G A A T C G C A T T T C C C G G A A T C A C A G

                    100                 110                 120
pRiA4b     T C A A G A G T T T - - T T A G C G C C G T T T T G G - - T -
pNGR234a   T C A A G A G T C T - - T T G G C A C C G G A A C G G - G T -
pTiB6S3    T C A A G A G T C C C G T G A G G A A A G T A T C G T - T T C
pRL8JI     T C A A G A G T C - - - - - - A A C G C C A C A C C G G C G T -

                  130                 140                 150
pRiA4b     - - - G A G C T G A T T T C C T T T G C C T G C T G A A A G G
pNGR234a   - - - G A G C G G A C G T C T T T T G C C T G A G G A T A G G
pTiB6S3    G A C G A G C T G A T T T C T T T T G C C T A A C - A A A G G
pRL8JI     - - - - - A G C C T - T T T C - T T T G C C T T G C G A A A G G

                  160
pRiA4b     T G A A A G A T G -
pNGR234a   T G A A A G A A G -
pTiB6S3    T A C A A G G A - -
pRL8JI     T G - A A G G A C A
```

Multiple alignments of the nucleotide sequence of the replication origins of: the Ri plasmid of *Agrobacterium rhizogenes* (pRiA4b), the symbiotic replicon of NGR234 (pNGR234*a*), the Ti plasmid of *A. tumefaciens* BS63 (pTiBS63) and pRL8JI of *R. leguminosarum* bv. *leguminosarum* (pRL8JI). Gaps introduced to give the best sequence alignments are marked by hyphens.

FIG. 6

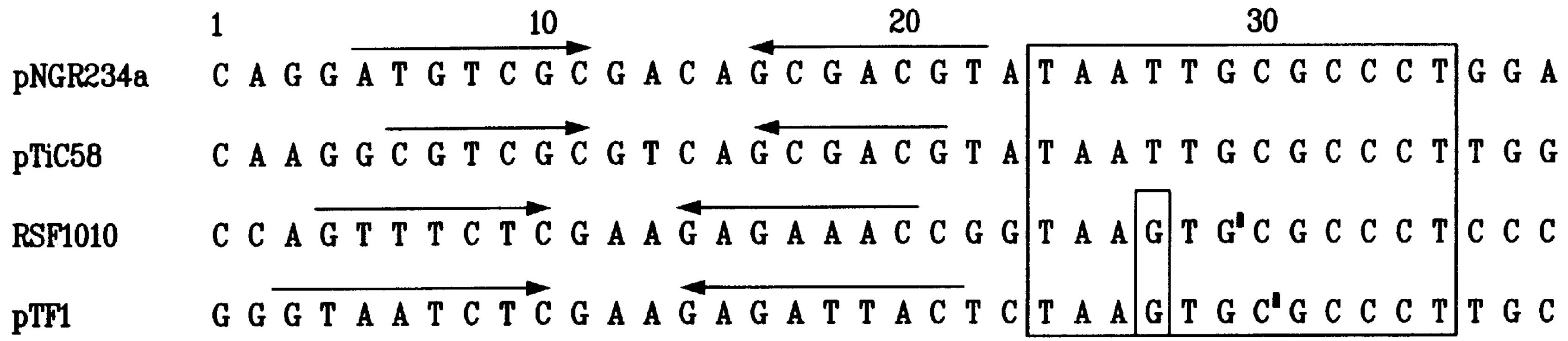

Multiple DNA sequence alignments of the regions containing the origin of transfer of: the symbiotic plasmid of NGR234; pTiC58, the Ti plasmid of *A. tumefaciens* C58; RSF1010, a mobilisable plasmid of *E. coli*, and; pTF1, a mobilizable plasmid of *Thiobacillus ferrooxidans* . Major conserved nucleotide residues are boxed. Known "nick" sites corresponding to the nucleotide positions where the specific plasmid strand is cleaved are marked (z). Sequence features in the trailing portion of the *oriT* sites include inverted repeats which are marked by horitzontal arrows.

FIG. 7

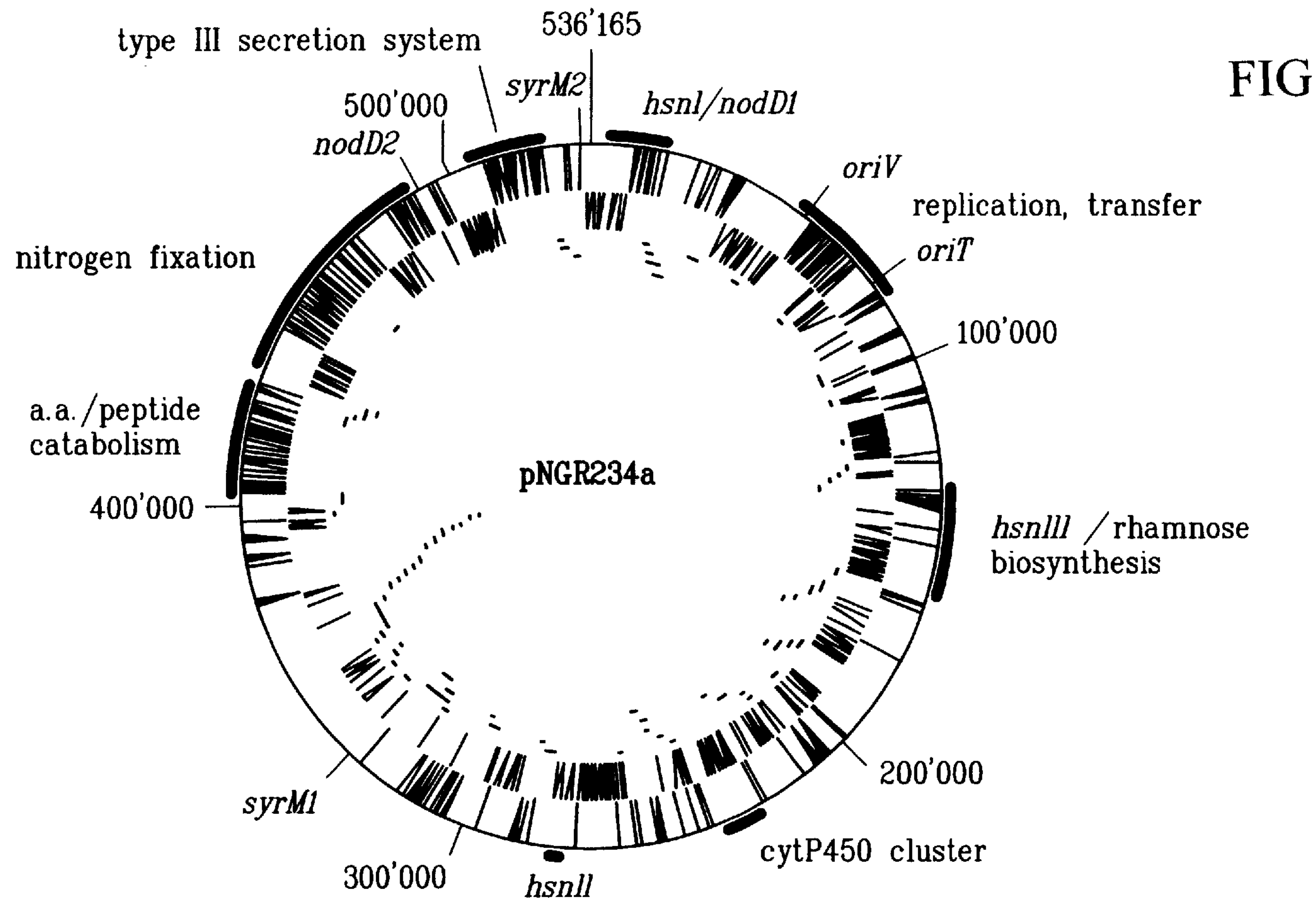

Circular representation of the symbiotic plasmid of NGR234. Outer and inner concentric circles: coding regions identified on the plus and minus strands respectively. ORFs which belong to insertion-like elements are not visible. Thin concentric black lines represent mosaic sequences as well as complete or partial IS like repeats. Major gene clusters are highlighted as thick black concentric lines.

GENOMIC SEQUENCE OF RHIZOBIUM SP. NGR 234 SYMBIOTIC PLASMID

TECHNICAL FIELD

This invention relates to a symbiotic plasmid of the broad host-range Rhizobium sp. NGR234 and its use. In particular, this invention relates to the isolation and analysis of the complete sequence of the NGR234 symbiotic plasmid pNGR234a, and the open reading frames (ORFs) identifiable therein as well as the proteins expressible from said ORFs.

BACKGROUND OF THE INVENTION

Together with carbon, hydrogen and oxygen, nitrogen is one of the essential components in organic chemistry. Although it is present in vast quantities in the atmosphere, nitrogen in its diatomic form $N_2$ remains unassimilable by living organisms. The nitrogen cycle begins by the fixation of nitrogen into ammonia which is chemically more reactive and can be assimilated into the food chain. A large fraction of the total nitrogen fixed every year is produced by microorganisms. Among these, the soil bacteria of the genera Azorhizobium, Bradyrhizobium, Sinorhizobium and Rhizobium, generally referred to as rhizobia, fix nitrogen in symbiotic associations with many plants from the Leguminosae family. This highly specific interaction leads to the formation of specialized root-, and in the case of Azorhizobium, stem-structures called nodules. It is within these nodules that rhizobia differentiate into bacteroids capable of fixing atmospheric nitrogen into ammonia. In turn, ammonia diffuses into the vegetal cells and sustains plant growth even under limiting nitrogen conditions.

The Rhizobium-legume interaction presents many interesting features. Obviously, the possibility of using this symbiosis as an “environmentally friendly” way to provide some of the most important world crops (such as soybean, bean and many other legumes) with fixed nitrogen without using nitrate-rich fertilizers, has important economic consequences. It is also an ideal model to study a non-pathogenic interaction between bacteria and a highly developed, multicellular organism such as the host plant. Furthermore, the various steps involved in the establishment of a functional nitrogen symbiosis, which include some dramatic morphological changes as well as processes of cellular differentiation, require a complex exchange of molecular signals. Despite many decades of studies, it is only recently that the Rhizobium-legume interaction has been partially understood at the molecular level. The establishment of a functional symbiosis can be divided into two major steps as follows.

(A) Rhizosphere Ecology and Modulation

Rhizobia are soil bacteria that proliferate in the rhizosphere of compatible plants, taking advantage of the many compounds released by plant roots. In return it has been shown that the presence of rhizobia in the rhizosphere reduces susceptibility of plants to many root diseases. In the case of low nitrogen levels in the soil, compatible rhizobia can interact with host plants and start the nodulation process (Long, 1989; Fellay et al., 1995; van Rhijn and Vanderleyden, 1995). Molecular signalling between the two partners begins with the release by the plant of phenolic compounds (mostly flavonoids) that induce the expression of nodulation genes (referred to as nod, nol and noe genes). The NodD1 gene product appears to be the central mediator between the plant signal and nodulation gene induction (Bender et al., 1988). It is modified by the binding of flavonoids and acts as a positive regulator on the expression of the remaining nodulation genes. Among them, the nodABC loci encode products responsible for the synthesis of the core structure of lipooligosaccharides called Nod factors (Relić et al., 1994). More nodulation genes are involved in strain-specific modifications of the Nod factors as well as in its secretion. It seems established now that variability in the structure of Nod factors may play a significant role in the determination of the host-range of a given Rhizobium strain, that is in its ability to efficiently nodulate different legumes. For example, the strain *Rhizobium meliloti* can only nodulate Medicago, Melilotus and Trigonella ssp., whereas Rhizobium sp. NGR234 can symbiotically interact with more than 105 different genera of plants, including the non-legume *Parasponia andersonii.*

The structure of many Nod factors, their isolation from Rhizobium strains and their commercial application in agriculture have been described (NodNGR-Faktoren: Relić et al., 1994; WO 94/00466; NodRm-Faktoren: WO 91/15496). Secreted Nod factors act in turn as signal molecules that allow rhizobia to enter young root hairs of a host plant, and induce root-cortical cell division that will produce the future nodule. Invaginated rhizobia progress towards the forming nodule within infection threads that are synthesized by the plant cells. Bacteria are then released into the cytoplasm of dividing nodule cells where they differentiate into bacteroids capable of fixing atmospheric nitrogen.

With respect to regulation of the nodulation genes, other regulatory genes with similarities to nodD1 (genes that belong to the lysR family) have been identified in various strains (Davis and Johnston, 1990). The function of these genes, called nodD2, nodD3 or syrM, is only partially understood. Some nodD genes have been described (WO 94/00466; CA 1314249; WO 87/07910; U.S. Pat No. 5,023, 180). Also, recombinant DNA molecules including the consensus sequence of the promoters of nodD1-regulated genes, called nod-boxes (Fisher and Long, 1993), have been disclosed (U.S. Pat. Nos. 5,484,718; 5,085,588). Finally, recombinant plasmids with the nodABC genes or, in one case (*Bradyrhizobium japonicum*), a sequence influencing host specificity have been disclosed (U.S. Pat. Nos. 5,045, 461; 4,966,847).

(B) Symbiotic Nitrogen Fixation

Inside the nodules, rhizobia differentiate into bacteroids that express the enzymatic complex (nitrogenase) required for the reduction of atmospheric nitrogen into ammonia. The nitrogenase is encoded by three genes nifH, nifD and nifK which are well conserved in nitrogen fixing organisms (Badenoch-Jones et al., 1989). Many additional loci are necessary for functional nitrogenase activity. Those originally identified in *Klebsiella pneumoniae* are known as nif genes, whereas those found only in Rhizobium strains are described as fix genes (Fischer, 1994). Some of these gene products are required for the biosynthesis of cofactors, the assembly of the enzymatic complex or play regulatory and different accessory roles (oxygen-limited respiration, etc.). Many of these genes are less conserved among the various rhizobial strains and in some cases their function is still not fully understood. The high sensitivity of the nitrogenase complex to free oxygen requires a very strict control of most nif and fix gene expression. In this respect, the FixL, FixJ, FixK, NifA and RpoN proteins have been identified in representative Rhizobium species as the major regulatory elements that, in microanaerobic conditions, activate the synthesis of the nitrogenase complex (Fischer, 1994). Recombinant DNA molecules containing nif genes/promoters have been disclosed: nifH promoters of *B. japonicum* (U.S. Pat. No. 5,008,194), nifH and nifD promoter of *R. japonicum* (EP 164245), nifA of *B. japonicum* and *R. meliloti* (EP 339830), nifHDK and hydrogen-uptake (hup) genes of *R. japonicum* (EP 205071).

Many more genetic determinants play a significant role in the Rhizobium-legume symbiosis. Genes (exo, lps and ndv genes) involved in the production of extracellular polysaccharides (EPS), lipopolysaccharides (LPS) and cyclic glucanes of rhizobia play an essential role in the symbiotic interaction (Long et al., 1988; Stanfield et al., 1988). Mutation in these genes negatively influences the development of functional nodules. In this respect, some exopolysaccharides of the NGR234 derivative strain ANU280, have been disclosed (WO 87/06796). Although Nod factors seem to play a key role in the nodulation process, experimental data indicate that other signal molecules produced by the bacterial symbionts are required for functional symbiosis and may play a role in coordinating various steps such as the controlled invasion process, the release of rhizobia from the infection thread into the plant cell cytoplasm, the bacteroid differentiation process, etc. Moreover, the need for rhizobia to survive in the rhizosphere and to compete adequately with other microorganisms requires many more unidentified genes that, although they may not be characterised as proper symbiotic loci, do affect the efficiency of the various strains to induce functional nitrogen fixing symbiosis in field conditions. Finally, in our view genetic engineering of improved rhizobial strains cannot be pursued without a more extended knowledge of the structure and complexity of the Rhizobium symbiotic genome.

In this respect we decided to determine the complete DNA sequence of a symbiotic plasmid of Rhizobium sp. NGR234. In contrast to Bradyrhizobium and Azorhizobium that carry symbiotic genes on large chromosomes (ca. 8 Mbp) and to *R. meliloti* that harbours two very large symbiotic plasmids of 1.4 and 1.6 Mbp, NGR234 carries a single plasmid of ca. 500 kbp, pNGR234a. Moreover, it has been shown by transfer of pNGR234a into heterologous rhizobia, and even into non-nodulating *Agrobacterium tumefaciens,* that most nodulation functions are encoded by this plasmid (Broughton et al., 1984). The fact that NGR234 is able to interact symbiotically with more plants than any other known strain, and that a complete ordered cosmid library of pNGR234a was available, reinforced NGR234 as the best choice for a large-scale sequencing effort on a symbiotic plasmid (Perret et al., 1991; Freiberg et al., 1997).

Automated fluorescent methods have been used to sequence cosmids from eukaryotic organisms, including *Saccharomyces cerevisiae* (Levy, 1994), *Caenorhabditis elegans* (Sulston et al., 1992), *Drosophila melanogaster* (Hartl and Palazzolo, 1993), and *Homo sapiens* (Bodmer, 1994), as well as chromosomes from the prokaryotes *Haemophilus influenzae* (Fleischmann et al., 1995) and *Mycoplasma genitalium* (Fraser et al., 1995). In most large-scale sequencing centres this technology is based mainly on the shotgun approach. After random fragmentation of DNA (e.g. cosmids, bacterial artificial chromosomes (BACs), entire chromosomes) using sonication or mechanical forces, size-selected fragments are subcloned into M13 phages, phagemids or plasmids and sequenced by cycle sequencing using dye primers (Craxton, 1993). A disadvantage of this method is that DNA regions with elevated GC contents produce large numbers of compressions (unresolvable foci in sequence gels) in the dye primer sequences leading to several hundred compressions per assembled cosmid sequence. It is known that the use of dye terminators—fluorescently labelled dideoxynucleoside triphosphates—instead of dye primers reduces the number of compressions (Rosenthal and Charnock-Jones, 1993). Therefore, dye terminators are frequently being used for gap closure and proofreading after assembly of the shotgun data.

To sequence GC-rich cosmids with the highest accuracy, the effectiveness of shotgun sequencing with dye terminators in comparison to dye primer sequencing was investigated. To improve the incorporation of dye terminators into DNA, a modified Taq DNA polymerase carrying a single mutation was used (Tabor and Richardson, 1995). This enzyme has properties similar to a thermostable "sequenase" and is commercially available as Thermo Sequenase (Amersham, Buckinghamshire, UK) or AmpliTaq FS (Perkin-Elmer, Foster City, Calif., USA). Concentrations of dye terminators needed in the cycle sequencing reactions can be reduced by 20–250 times. It was found that dye terminator shotgun sequencing leads to compression-free raw data that can be assembled much faster than shotgun data mainly obtained by dye primer sequencing. This strategy thus allows a several-fold increase in speed to sequence individual cosmids. This was demonstrated by comparing assembly of the sequence data of two cosmids from pNGR234a generated by different chemistries: Cosmid pXB296 was sequenced with dye terminators, whereas data for pXB110 were obtained using the common dye primer method. Also disclosed is the analysis of the entire pXB296 sequence.

Moreover, the dye terminator shotgun sequencing strategy used to generate the sequence data for pXB296 was also used to sequence all the other remaining overlapping cosmids of the plasmid pNGR234a. In summary, 20 cosmids have been sequenced together with two PCR products and a subcloned DNA fragment derived from a cosmid identified as pXB564 in order to generate the plasmid's complete nucleotide sequence.

After its assembly, the analysis of the entire nucleotide sequence of pNGR234a, especially the determination of putative coding regions and the prediction of their expressible proteins and putative functions, was performed. Initially, analysis of the region covered by cosmid pXB296 was extended to cosmids pXB368 and pXB110. Thus, in approximately 100 kb of the plasmid (position 417,796–517,279) most ORFs and their deduced proteins with different putative functions were predicted. Subsequently, the rest of pNGR234a was analyzed.

SUMMARY OF THE INVENTION

The present invention provides the complete nucleotide sequence of symbiotic plasmid pNGR234a or degenerate variants thereof of Rhizobium sp. NGR234.

The present invention also contemplates sequence variants of the plasmid pNGR234a altered by mutation, deletion or insertion.

Also encompassed by the present invention are each of the ORFs derivable from the nucleotide sequence of pNGR234a or variants thereof.

In a preferred embodiment, the ORFs derived from the nucleotide sequence of pNGR234a encode the functions of nitrogen fixation, nodulation, transportation, permeation, synthesis and modification of surface poly- or oligosaccharides, lipo-oligosaccharides or secreted oligosaccharide derivatives, secretion (of proteins or other biomolecules), transcriptional regulation or DNA-binding, peptidolysis or proteolysis, transposition or integration, plasmid stability, plasmid replication or conjugal plasmid transfer, stress response (such as heat shock, cold shock or osmotic shock), chemotaxis, electron transfer, synthesis of isoprenoid compounds, synthesis of cell wall components, rhizopine metabolism, synthesis and utilization of amino acids, rhizopines, amino acid derivatives or other biomolecules, degradation of xenobiotic compounds, or encode proteins exhibiting similarities to proteins of amino acid metabolism or related ORFs, or enzymes (such as oxidoreductase, transferase, hydrolase, lyase, isomerase or ligase).

In another preferred embodiment, the ORFs are under the control of their natural regulatory elements or under the control of analogues to such natural regulatory elements.

The present invention also provides the sequences of the intergenic regions of pNGR234a which, in a preferred embodiment, are regulatory DNA sequences or repeated elements. In a further preferred embodiment, the intergenic sequences are ORF-fragments.

Also provided by the present invention are mobile elements (insertion elements or mosaic elements) derivable from the nucleotide sequences of the present invention.

The present invention also contemplates the use of the disclosed nucleotide sequences or ORFs in the analysis of genome structure, organisation or dynamics.

Also provided by the present invention is the use of the nucleotide sequences or ORFs in the subcloning of new nucleotide sequences. In a preferred embodiment, the new nucleotide sequences are coding sequences or non-coding sequences.

In yet a further preferred embodiment, the nucleotide sequences or ORFs are used in genome analysis and subcloning methods as oligonucleotide primers or hybridization probes.

The present invention further provides proteins expressible from the disclosed nucleotide sequences or ORFs.

Also contemplated by the present invention is the use of the disclosed nucleotide sequences, individual ORFs or groups of ORFs or the proteins expressible therefrom in the identification and classification of organisms and their genetic information, the identification and characterisation of nucleotide sequences, the identification and characterisation of amino acid sequences or proteins, the transportation of compounds to and from an organism which is host to said nucleotide sequences, ORFs or proteins, the degradation and/or metabolism of organic, inorganic, natural or xenobiotic substances in a host organism, or the modification of the host-range, nitrogen fixation abilities, fitness or competitiveness of organisms.

The present invention also provides plasmid pNGR234a of Rhizobium sp. NGR234 comprising the disclosed nucleotide sequence or any degenerate variant thereof.

The present invention also provides a plasmid harbouring at least one of the disclosed ORFs or any degenerate variant thereof.

The plasmids of the invention may be produced recombinantly and/or by mutation, deletion, insertion or inactivation of an ORF, ORFs or groups of ORFs.

The present invention also provides the use of the disclosed plasmids or variants thereof in obtaining a synthetic minimal set of ORFs required for functional Rhizobium-legume symbiosis, the modification of the host-range of rhizobia, the augmentation of the fitness or competitiveness of Rhizobium sp. NGR234 in the soil and its nodulation efficiency on host plants, the introduction of desired phenotypes into host plants using the disclosed plasmids as stable shuttle systems for foreign DNA encoding said desired phenotypes, or the direct transfer of the disclosed plasmids into rhizobia or other microorganisms without using other vectors for mobilization.

The nucleotide sequences of the present invention were advantageously obtained using known cycle sequencing methods. The preferred dye terminator/thermostable sequenase shotgun sequencing method used to generate the nucleotide sequences of the present invention, when applied to cosmids and when compared to other sequencing methods, was shown to yield sequence reads of the highest fidelity. Consequently, the speed of assembly of particular cosmids was increased, and the resultant high-quality sequences required little editing or proofreading. Thus, the preferred sequencing method described herein was successfully used to generate the complete nucleotide sequence of all the overlapping cosmids of plasmid pNGR234a, thereby resulting in the assembly of the complete sequence of the plasmid.

The complete sequence of pNGR234a is disclosed for the first time in this application, as are the majority of the ORFs predicted within the sequence. Putative functions have been ascribed to the novel and inventive ORFs disclosed herein and the proteins for which they code.

BRIEF DESCRIPTION OF DRAWINGS

The present invention is described below and illustrated thereafter in the appended examples, with reference to the following figures:

FIG. 1 A comparative graph showing the comparison of sequences from pXB296 created by different cycle sequencing methods.

FIG. 2 A schematic diagram showing the organization of the predicted ORFs in pXB296 from Rhizobium sp. NGR234.

FIG. 3 The complete nucleotide sequence of plasmid pNGR234a (with the pages labelled sequentially from 19961 to 1996142).

FIG. 4 A schematic diagram showing the map of the 20 sequenced cosmids covering the 536 kb symbiotic plasmid pNGR234a of Rhizobium sp. NGR234.

FIG. 5 A diagram indicating multiple alignments of the nucleotide sequence of the replication origins of various plasmids.

FIG. 6 A diagram indicating multiple DNA sequence alignments of the regions containing the origin of transfer of various plasmids.

FIG. 7 A schematic diagram showing a circular representation of the symbiotic plasmid pNGR234a of NGR234.

DETAILED DESCRIPTION OF THE INVENTION AND BEST MODE

Comparison of Different Shotgun Sequencing Strategies

The following is a more detailed description of certain key aspects of the present invention.

GC-rich cosmids were examined to investigate whether they could be sequenced much more efficiently using dye terminators throughout the shotgun phase instead of dye primers. As a test case, cosmid pXB296 with a GC content of 58 mol % from pNGR234a, the symbiotic plasmid of Rhizobium sp. NGR234, was exclusively sequenced using dye terminators in combination with a thermostable sequenase [Thermo Sequenase (Amersham)]. Another rhizobial cosmid with identical GC content, pXB110, was sequenced using traditional dye primer chemistry and Taq DNA polymerase.

Using the dye terminator/thermostable sequenase shotgun strategy, it was shown that most, if not all, compressions could be resolved and reads were produced with the highest fidelity among all sequencing chemistries tested. As a result, a much faster assembly of cosmid pXB296 in comparison to pXB110 was obtained. The shotgun data could be assembled into a high-quality sequence without extensive editing and proofreading. By measuring the error rate in overlapping regions between individual cosmids from pNGR234a, as well as the cosmid vector sequence itself (data not shown), it was estimated that the accuracy of the pXB296 sequence is higher than 99.98%. Using other thermostable sequenases such as AmpliTaq FS (Perkin-Elmer), similar results were expected because thermostable sequenases have similar properties.

Dye primer chemistry in combination with Thermo Sequenase was also examined. Although the peak uniformity of signals was much improved over dye primer/Tag DNA polymerase data, the number of compressions in GC-rich shotgun reads was not reduced significantly. Compressions in shotgun raw data enormously increase the overall effort of editing, proofreading, and finishing a cosmid as shown for pXB110 (Table 1).

Because of their longer reading potential, dye primer reads are helpful for gap closure. However, using ABI 373A sequencers (Applied Biosystems, Inc. (ABI), Perkin-Elmer, Foster City, Calif., USA), dye primer reads are, on average, only ~50 bases longer than dye terminator reads.

Using the experimental conditions of the present invention, shotgun sequencing with dye terminators and a thermostable sequenase is superior because for GC-rich cosmid templates it removes most of the compressions and this leads to a several-fold improvement in assembling and finishing of cosmid-sized projects. Although dye terminators are slightly more expensive than dye primers, the overall saving in time for finishing projects has, in our experience, a much greater effect on general costs.

It has been shown that the strategy of the present invention is effective for high-throughput shotgun sequencing of GC-rich templates. This strategy was therefore used to sequence the remaining 19 overlapping cosmids of the symbiotic plasmid pNGR234a of Rhizobium sp. NGR234. In total, 20 cosmids, two PCR products (1.5 and 2.0 kb in length) and a 1.5 kb restriction fragment were sequenced in order to generate the complete pNGR234a sequence (FIG. 4).

TABLE 1

Comparison of the assembly of the sequence data from cosmids pXB296 (dye terminator shotgun reads) and pXB110 (dye primer shotgun reads)

| Data assembly | pXB296 | pXB110 |
|---|---|---|
| Average length of the shotgun reads (bases) | 332 | 378 |
| No. of shotgun reads used for assembly | 786 | 899 |
| No. of shotgun reads assembled with 4% mismatch[a] | 736 | 308 |
| No. of shotgun reads assembled with 25% mismatch[a] | 775 | 879 |
| No. of contigs[b] longer than 1 kbp | 3 | 25 |
| No. of contigs left after editing[c] | 2 | 4 |
| No. of additional reads (gap closure and proofreading)[d] | 32 | 191 |
| Total length of cosmid insert (bp) | 34,010 | 34,573 |
| Sequencing redundancy (per bp) | 8.0 | 10.5 |

[a]Assembling program: XGAP; principal autoassembling conditions: normal shotgun assembly, joins permitted, minimum initial match = 15, maximum no. of pads per reading during the alignment procedure = 8, maximum no. of pads per reading in contig to align any new reading = 8, alignment mismatches 4% and 25%, respectively.
[b]Contiguous parts of sequence created by overlapping reads.
[c]Lengths of contigs: 6–10 kbp (pXB296); 2–12 kbp (pXB110).
[d]Reads necessary for closing gaps and making single-stranded regions double-stranded by primer walking on selected templates and, in case of pXB110, for solving ambiguities (compressions) by the resequencing of clones with universal primer and dye terminators.

Genetic Organization of pXB296

All 28 predicted open reading frames (ORFs) in pXB296 (FIG. 2) show significant homologies to database entries (Table 2). The first putative gene cluster (cluster I) containing ORF1 to ORF5 corresponds to various oligopeptide permease operons (Hiles et al., 1987; Perego et al., 1990). Only ORF5 shows homology to a gene from a different bacterium, *Bacillus anthracis* (Makino et al., 1989). Each homologue encodes membrane-bound or membrane-associated proteins suggesting that all five ORFs are involved in oligopeptide permeation.

Organization of the predicted gene cluster IV, including the nifA homologue ORF16 (fixABCX, nifA, nifB, fdxN, ORF, fixU homologues, position 16,746–24,731), the predicted locations of the $\sigma^{54}$-dependent promoters and the nifA upstream activator sequences (FIG. 2), correspond to the organization found in *Rhizobium meliloti* and *Rhizobium leguminosarum* bv. *trifolii.* (Iismaa et al., 1989; Fischer, 1994). NifA is a positive transcriptional activator (Buikema et al., 1985), whereas nif and fix genes are essential for symbiotic nitrogen fixation. Identification of $\sigma^{54}$-dependent promoter sequences, together with the upstream activator motifs upstream of ORF21, ORF22, and ORF23, suggests that these ORFs may play an important, but still undefined, role in symbiosis.

Inevitably, large-scale sequencing uncovers differences with already published sequences. van Slooten et al. (1992) cloned a 5.8 kb EcoRI fragment from Rhizobium sp. NGR234 and sequenced 2067 bp by manual radioactive methods (EMBL accesion no. S38912). This sequence exhibits 2.4% mismatches with the corresponding sequence in pXB296.

TABLE 2

Putative ORFs of pXB296 and homologies of the deduced amino acid sequences to known proteins

| ORF[a] | st.[b] | position on cosmid (base no.)[c] | ribosomal binding site: SD-sequence - distance from start codon (bases)- start codon[d] SD-Sequence: 5'-TAAGGAGGTGA-3' | no. of deduced amino acids | homologous amino acids (position) | homologous protein name | length (aa)[e] | function[f] | accession no. | identity (%)[g] | similarity (%)[g] |
|---|---|---|---|---|---|---|---|---|---|---|---|
| ORF1[h] | + | 00001–00625 | | >207 | 1–207 | OppB | 306 | oligopeptide | X05491 | 45 | 68 |
| ORF2 | + | 00628–01503 | GTATCCGGT-7-ATG | 291 | 2–289 | OppC | 305 | permease | X56347 | 37 | 63 |
| ORF3 | + | 01505–02512 | AGCGGAGG-7-ATG | 335 | 8–327 | OppD | 336 | proteins | X56347 | 49 | 69 |
| ORF4 | + | 02509–03570 | TGAAGTGGT-6-ATG | 353 | 2–323 | OppF | 334 | | X05491 | 51 | 69 |
| ORF5 | + | 03606–04991 | CAAGGA-6-ATG | 461 | 1–458 | CapA | 411 | encapsulation protein | M24150 | 25 | 48 |
| ORF6 | + | 05460–06863 | CCGAGAGG-8-ATG | 467 | 1–464 | BioA | 455 | aminotransferase | M29292 | 29 | 55 |
| ORF7 | + | 06888–08426 | GCCTTCGG-5-GTG | 512 | 97–509 | ORF[i] | 417 | unknown | D37877 | 36 | 58 |

TABLE 2-continued

Putative ORFs of pXB296 and homologies of the deduced amino acid sequences to known proteins

| ORF[a] | st.[b] | position on cosmid (base no.)[c] | ribosomal binding site: SD-sequence - distance from start codon (bases)- start codon[d] SD-Sequence: 5'-TAAGGAGGTGA-3' | no. of deduced amino acids | homologous amino acids (position) | homologous protein name | length (aa)[e] | function[f] | accession no. | identity (%)[g] | similarity (%)[g] |
|---|---|---|---|---|---|---|---|---|---|---|---|
| | | | | | 34–510 | GapD | 482 | succinic semialdehyde dehydrogenase | M38417 | 33 | 57 |
| ORF8 | – | 09781–10860 | GAACGTGG-8-ATG | 359 | 72–299 | ORF[i] | 414 | transposase homologue minicircle DNA | X15942 | 30 | 48 |
| ORF9 | + | 11124–12455 | ?-7-ATG | 443 | 2–443 | GLUD1 | 558 | glutamate dehydrogenase | M37154 | 41 | 60 |
| ORF10 | – | 13370–14116 | AAAGGA-6-ATG | 248 | 1–245 | ORF2[i] | 231 | transposase | X79443 | 45 | 64 |
| ORF11 | – | 14128–15672 | CATGGAG-7-TTG | 514 | 1–513 | ORF1[i] | 558 | homologues, IS1162 | X79443 | 41 | 62 |
| ORF12 | – | 16712–16942 | GAAGGA-8-ATG | 76 | 1–70 | FixU | 70 | unknown | P42710 | 63 | 80 |
| ORF13 | – | 16939–17265 | ACAAGAGG-7-ATG | 109 | 1–79 | ORF2[i] | >78 | unknown | X07567 | 53 | 81 |
| | | | | | 15–107 | NifZ | 159 | involved in FeMo-cofactor synthesis | M20568 | 39 | 56 |
| ORF14 | – | 17349–17543 | CCAGGAG-9-ATG | 64 | 1–64 | FdxN | 64 | ferredoxin-like | M21841 | 80 | 87 |
| ORF15 | – | 17585–19066 | AGTGGAG-7-ATG | 493 | 1–493 | NifB | 490 | involved in FeMo-cofactor synthesis | M15544 | 73 | 84 |
| ORF16 | – | 19292–20962 | ATTGG-12-ATG | 556 | 9–556 | NifA | 541 | transcriptional regulator | X02615 | 59 | 72 |
| ORF17 | – | 21129–21422 | AGGGGAG-7-ATG | 97 | 1–97 | FixX | 98 | required for | M15546 | 84 | 87 |
| ORF18 | – | 21437–22744 | AACTGAGGT-7-ATG | 435 | 1–435 | FixC | 435 | nitrogen | M15546 | 83 | 90 |
| ORF19 | – | 22755–23864 | ATAGGAG-6-ATG | 369 | 18–369 | FixB | 353 | fixation | M15546 | 79 | 89 |
| ORF20 | – | 23874–24731 | TAAAGAG-5-ATG | 285 | 1–285 | FixA | 292 | | M15546 | 74 | 85 |
| ORF21 | – | 25148–25468 | CCAGGAG-10-ATG | 106 | 1–106 | ORF118[i] | 108 | unknown | X13691 | 55 | 71 |
| ORF22 | – | 26145–26711 | GAAGGAG-9-ATG | 188 | 9–199 | — | 241 | hypothetical protein | U32739 | 47 | 64 |
| | | | | | 1–173 | — | 166 | peroxisomal protein | U11244 | 32 | 57 |
| ORF23 | + | 27169–27861 | GAAGGA-7-ATG | 230 | 1–167 | NifQ | 167 | probably involved in Mo-processing | X13303 | 37 | 57 |
| ORF24 | + | 27920–29434 | CTGGGAGG-18-ATG | 504 | 1–454 | DctA1 | 456 | $C_4$-dicarboxylate | S38912 | 97 | 98 |
| | | | | | 8–454 | DctA2 | 449 | transporter | S38912 | 97 | 98 |
| ORF25 | + | 29431–30675 | TTCGGCGG-12-ATG | 414 | 2–414 | CamC | 415 | cytP450-like | M12546 | 34 | 53 |
| ORF26 | + | 30676–31332 | TTGGG-5-TTG | 218 | 30–190 | LinA | 155 | γ-hexachloro-cyclohexan-dechlorinase | D90355 | 27 | 51 |
| ORF27 | + | 31329–33035 | AGTGGAG-10-ATG | 568 | 28–270 | FabG | 244 | reductase | M84991 | 38 | 57 |
| | | | | | 294–534 | | | | | 30 | 57 |
| ORF28[k] | + | 33173–34010 | CAAGGAG-5-ATG | >279 | 1–279 | LuxA | 355 | luciferase α-subunit | M10961 | 23 | 49 |

[a](ORF) Open reading frame.

[b](st.) Plus or minus strand.

[c]Position on cosmid: from the first base of the start codon to the last base of the stop codon; alternative start points are 6912/6927/7017 (ORF7), 10665/10656 (ORF8), 11220 (ORF9), 15699/15651 (ORF11), 17322/17271 (ORF13), 20995/21076 (ORF16), 26744 (ORF22), 27229/27304 (ORF23), 27941 (ORF24), and 30751/30754 (ORF26).

[d](SD sequence) Shine-Dalgamo sequence (Shine and Dalgamo 1974). Bases underlined are identical with the Shine-Dalgamo sequence. The following possible start codons were considered: ATG, GTG, or TTG.

[e](aa) Amino acids.

[f]Organisms: *Salmonella typhimurium, Bacillus subtilis* (OppBCDF), *Bacillus anthracis* (CapA), *Bacillus sphaericus* (BioA), *Streptomyces hygroscopicus* (ORF7 homolog), *Escherichia coli* (GapD), *Streptomyces coelicolor* (ORF8 homolog), *Homo sapiens* (GLUD1), *Pseudomonas fluorescens* (ORF10, ORF11 homologs), *Rhizobium leguminosarum* (FixU), *Rhodobacter capsulatus* (ORF13 homolog), *Azotobacter vinelandii* (NifZ), *Rhizobium meliloti* (FdxN, NifBA, FixXCBA), *Bradyrhizobium japonicum* (ORF118), *Haemophilus influenzae* (hypothetical protein), *Lipomyces kononenkoae* (peroxisomal protein), *Klebsiella pneumoniae* (NifQ), Rhizobium sp. NGR234 (DctA), *Pseudomonas putida* (CamC), *Pseudomonas paucimobilis* (LinA), *Escherichia coli* (FabG), *Vibrio harveyi* (LuxA).

[g]Identity and similarity were calculated using the program BESTFIT (Smith and Waterman 1981).

[h](ORF1) 3' end.

[i]Translated ORF.

[k](ORF28) 5' end.

It contains the gene dctA (encoding a $C_4$-dicarboxylate permease), which is 144 bases shorter than in pXB296. In this respect, a single nucleotide deletion in position 29,248 of the cosmid sequence close to the 3' end of the gene causes a frameshift leading to a DctA product extended by 48 residues. van Slooten et al. (1992) also failed to identify the nifQ homologue, ORF23 (position 27,169–27,861), presumably because they overlooked a small XhoI fragment located between positions 27,349 and 27,536 on pXB296. Expression studies allowed these investigators to define a putative $\sigma^{54}$-dependent promoter in a 1.7 kb SmaI fragment (position 27,094–28,818 in pXB296). This fragment stretches from the upstream region of ORF23 to the 5' part of dctA. The 58 bp intergenic region between ORF23 and dcta contains a stem-loop structure but no obvious promoter sequence. Possibly the promoter that controls dctA is located upstream of ORF23 (e.g. the minimal consensus sequence included in GGGGGCACAATTGC at position 27,098–27,111). Although clones containing dctA complemented mutants of *R. meliloti* and *R. leguminosarum* for growth on dicarboxylates, the growth of the NGR234 dctA deletion mutant was not affected (van Slooten et al., 1992). Nevertheless, this mutant was unable to fix nitrogen in nodules. Because dctA is now possibly part of a larger transcription unit, the symbiotic phenotype may also result from the inactivation of downstream genes.

Interestingly, the GC content of the predicted pXB296 ORFs ranges from 53.3 mol % to 64.6 mol %, with an overall cosmid GC content of 58.5 mol %. Genomes of Azorhizobium, Bradyrhizobium, and Rhizobium species have GC contents of 59 mol % to 65 mol % (Padmanabhan et al., 1990), with 62 mol % reported for Rhizobium sp. NGR234 (Broughton et al., 1972). Although pXB296 covers <7% of the complete symbiotic plasmid sequence, its lower overall GC value suggests that symbiotic genes might have evolved by lateral transfer from other organisms. In this case, methods of the type applied in the present invention will become even more relevant in sequencing the whole genome.

Genetic Organization of the 100 kb Region Covered by Cosmids pXB296, pXB368 and pXB110

Extending the analysis of pXB296 to a 100 kb region stretching from position 417,796 to 517,279 on the symbiotic plasmid pNGR234a led initially to the assignation of only 76 ORFs listed within Table 3 (excluding the first incomplete ORF noted in the analysis of pXB296 ("ORF1" of Table 2)). The ORFs y4tQ to y4vJ (excluding ORFs y4uD and y4uG and excluding ORF-fragments fu1, fu2, fu3, fu4 and fv1; see Table 3) are identical to the ORFs 2 to 28 of the analysis of pXB296 in Table 2 apart from minor revisions (N.B. the analysis recited in Table 3 should be taken as the definitive analysis—Table 2 merely represents preliminary findings). The cosmid pXB110, which was sequenced with the dye primer shotgun sequencing strategy in order to compare it with the dye terminator shotgun sequencing strategy used to sequence cosmid pXB296, in combination with pXB296 and pXB368 cover nearly this entire region. A PCR product and a restriction fragment of cosmid pXB564 also had to be sequenced in order to fill in the gap from position 480,607 to 483,991 between cosmids pXB368 and pXB110 (FIG. 4). Among the 76 predicted ORFs, 7 ORFs and their deduced proteins show no homologies to database entries. The other predicted ORFs and their deduced proteins do exhibit such homologies and therefore play putative roles in nitrogen fixation (ORFs y4uJ to y4vB, y4vE, y4vN to y4vR, y4wK and y4wL), nodulation (ORFs y4yC and y4yH), transportation (ORFs y4tQ to y4uA, y4vF and y4wM), secretion of proteins or other biomolecules (ORFs y4yI and y4yO), transcriptional regulation/DNA binding (ORFs y4wC and y4xI), in amino acid metabolism or metabolism of amino acid derivatives (ORFs y4uB, y4uC, y4uF, y4wD, y4wE and y4xN to y4yA), degradation of xenobiotic compounds (ORFs y4vG to y4vI), in peptidolysis/proteolysis (ORFs y4wA and y4wB) or transposition (ORFs y4uE, y4uH and y4uI) (see Table 3). The role of some ORFs like the luciferase-like ORFs (y4vJ and y4wF; see Table 3) in rhizobia is still not clear. In the 100 kb region, the duplication of a 5 kb sequence (position 451,886 to 456,157 and 483,764 to 488,035) including the genes nifHDK is remarkable. These genes encode the basic subunits of the nitrogenase. Furthermore, the transcriptional regulator nodD2 is very interesting because its role seems not to be identical to a previously identified nodD2 in a closely related strain (Appelbaum et al., 1988; data not shown). Also the pmrA-homologous ORF y4xI putatively plays an important role in regulating symbiotic processes because a nod box (binding region for the basic regulator nodD1; Fisher and Long, 1993) is located upstream of this ORF (position 493,962 to 494,000). Finally, the presence of ORFs (y4yI and y4yK to y4yN; see Table 3) homologous to type III secretion proteins, which have only been known previously in plant or animal/human pathogenic bacteria, shows that there only seems to be a subtle difference between symbiotic and pathogenic abilities of microorganisms.

TABLE 3

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | hom. protein length (aa)[d] | hom. protein accession no.[e] | I/ %[f] | S/ %[f] | note[g] |
|---|---|---|---|---|---|---|---|---|---|---|---|
| y4aA | | −2/3 | 534696–000474 | 647 | 16-646 | Shc | 658 | X86552 | 78 | 88 | prob. squalene-hopene-cyclase; put. operon y4aABCD: inv. in synthesis of an isoprenoid compound |
| y4aB | | −3 | 000523–001776 | 417 | 6-415 | ORF1 | 414 | X80766 | 43 | 63 | put. flavoprotein oxidoreductase |
| y4aC | | −2 | 001776–002615 | 279 | 3-247 | Psy1 | 419 | X68017 | 34 | 50 | put. phytoene synthase |
| y4aD | | −1 | 002612–003490 | 292 | 10–195 | Crt1 | 342 | L37405 | 33 | 51 | hyp. protein hom. to squalene and phyto- |
| fa1 | | −3 | 003487–004011 | | | | | | | | ene synthetases fragmentous character |
| y4aF | nolK | −3 | 005173–006117 | 314 | 9-310 | ORF14.8 | 321 | U46859 | 51 | 70 | put. NAD-dep. nucleotide sugar epimerase/ dehydrogenase; NoeJKL/NodZ/NolK inv. in biosynthesis of fucose moiety of Nod factors |
| y4aG | noeH | −2 | 006126–007181 | 351 | 4-339 | RfbD | 348 | U24571 | 65 | 80 | put. GDP-D-mannose dehydratase |
| y4aH | nodZ | −1 | 007426–008394 | 322 | 3-254 | NodZ | 324 | L22756 | 69 | 83 | put. fucosyltransferase |
| y4aI | noeK | −3 | 008623–010047 | 474 | 5-471 | ORF5 | 483 | U47057 | 42 | 59 | put. phosphomannomutase |
| y4aJ | noeJ | +3 | 010110–011648 | 512 | 33-498 | XanB | 466 | M83231 | 50 | 65 | put. mannose-1-phosphate guanylyl- transferase |
| y4aK | | +2 | 012125–012277 | 50 | | | | | | | hyp. 5.5 kd protein |
| y4aL | nodD1 | +2 | 012380–013348 | 322 | 1-322 | NodD1 | 322 | Y00059 | 98 | 99 | transcriptional regulator (LysR family); |
| | | | | | 1-310 | NodD2 | 312 | this work | 68 | 84 | high similarity to Y4xH(NodD2) |
| y4aM | | +3 | 013911–014342 | 143 | 7-132 | ORF3 | 127 | L13845 | 50 | 66 | put. DNA-binding protein; high |
| | | | | | 1-143 | Y4wC | 143 | this work | 69 | 77 | similarity to Y4wC |
| y4aN | | +1 | 014488–014934 | 148 | 1-129 | ORF3 | 128 | X04833 | 41 | 56 | homologue located nearby the replicator region of pRiA4b |
| y4aO | | +3 | 015065–015643 | 192 | | | | | | | hyp. 21.8 kd protein; low similarity to Y4nF(<30% id.) |
| y4aP | mucR | +3 | 016161–016592 | 143 | 1-143 | MucR | 143 | L37353 | 89 | 95 | put. transcriptional regulator (Ros/MucR family); similarity to Y4pD; possibly inv. in regulation of exopolysaccharide synthesis |
| y4aQ | | −2 | 017016–017582 | 188 | 15-167 | No1265 | 266 | X74068 | 33 | 50 | hyp. 20.4 kd protein; similar to Y4hP, Y4jD, Y4qI |
| y4aR | | +2 | 017798-018121 | 107 | | | | | | | hyp. 12.1 kd protein |
| y4aS | | +1 | 018121-018666 | 181 | | | | | | | hyp. 20 kd protein |
| fa2 | | +3 | 018912–019664 | 250 | 126-250 | Tnp | 465 | U04047 | 38 | 51 | hyp. protein fragment |
| | | | | | 78-150 | Y4iG | 90 | this work | 93 | 97 | |
| | | | | | 3-266 | Y4bF | 457 | this work | 53 | 73 | |
| y4bA | | −2 | 019674- 021758 | 694 | 1-393 | fo6 | 430 | this work | 89 | 95 | hyp. 78.7 kd protein; identical to Y4pH |
| | | | | | 406-532 | fo5 | 136 | this work | 83 | 94 | |
| | | | | | 532-694 | fo4 | 143 | this work | 77 | 83 | |
| y4bB | | −3 | 021748–022014 | 88 | 2-88 | Y4oL | 88 | this work | 63 | 69 | hyp. 9.7 kd protein precurser; identical to Y4pI |
| y4bC | | −1 | 022034–022483 | 149 | 1-149 | Y4oM | 149 | this work | 79 | 88 | hyp. 16.8 kd protein; identical to Y4pJ |
| y4bD | | −2 | 022674–022943 | 89 | 20-89 | Y4oN | 70 | this work | 73 | 84 | hyp. 10.2 kd protein; identical to Y4PK |
| fb1 | | +2 | 022985–023659 | 224 | 36-224 | Y4bF | 457 | this work | 42 | 63 | hyp. protein fragment |

TABLE 3-continued

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | hom. protein length (aa)[d] | hom. protein accession no.[e] | I/ %[f] | S/ %[f] | note[g] |
|---|---|---|---|---|---|---|---|---|---|---|---|
| y4bF | | +1 | 023953–025326 | 457 | 130-436 | Tnp | 465 | U04047 | 31 | 46 | put. transposase; |
| | | | | | 2-265 | Fa2 | 266 | this work | 53 | 73 | upstream of this ORF (23875– |
| | | | | | 77-169 | Y4iG | 90 | this work | 51 | 72 | 23987) 89% nt-id. to part |
| | | | | | 285-457 | Fb1 | 188 | this work | 42 | 63 | of origin of replication-region |
| | | | | | 410-457 | Y4JM | 70 | this work | 75 | 79 | (*R. meliloti;*, S66221) |
| y4bG | | +1 | 025870–026685 | 271 | | | | | | | hyp. 30 kd protein precurser |
| y4bH | | +1 | 028513–028788 | 91 | | | | | | | hyp. 9.6 kd integral membrane protein |
| y4bI | | +3 | 028860–029276 | 138 | 3-108 | HI1631 | 190 | U00085 | 41 | 61 | hyp. 15.3 kd protein precurser |
| y4bJ | | +1 | 029392–031284 | 630 | 429-564 | HtrA | 503 | L20127 | 40 | 53 | hyp. 67.9 kd integral membrane protein, distantly related to peptidase family S2C |
| y4bK | | +2 | 031625–032293 | 222 | 83-212 | ORF1 | 215 | D84146 | 25 | 45 | hyp. 24.3 kd protein |
| y4bL | | +1 | 032641–034191 | 516 | 7-515 | ORF1 | 558 | X79443 | 44 | 63 | identical to Y4kJ and Y4tB; similar to Fo3 and Fo7; put. transposase |
| | | | | | 6-516 | Y4ul | 515 | thiswork | 48 | 66 | |
| y4bM | | +3 | 034188–034979 | 263 | 1-203 | ORF2 | 231 | X79443 | 45 | 62 | identical to Y4kI and Y4tA; put. |
| | | | | | 6-248 | Y4pL | 245 | this work | 55 | 73 | insertion sequence ATP- binding |
| | | | | | 6-254 | Y4uH | 248 | this work | 48 | 68 | protein; similarity to Y4pL, Y4uH, |
| | | | | | 1-263 | Y4iQ | 298 | this work | 31 | 56 | also to Y4sD/Y4nD/Y4iQ |
| y4bN | | +1 | 035278–036573 | 431 | | | | | | | hyp. 47.6 kd protein |
| y4bO | | +1 | 036646–038466 | 606 | | | | | | | hyp. 66.8 kd protein |
| y4cA | | −1 | 038576–042169 | 1197 | | | | | | | hyp. 137.7 kd protein; largest protein in pNGR234a |
| y4cB | | −3 | 042226–042522 | 98 | | | | | | | hyp. 10.2 kd integral membrane protein |
| y4cC | | −3 | 042556–044109 | 517 | | | | | | | hyp. 57.8 kd protein |
| y4cD | | −2 | 044106–046028 | 640 | | | | | | | hyp. 71.6 kd protein |
| y4cE | | −3 | 046486–047661 | 391 | | | | | | | hyp. 43.4 kd protein |
| y4cF | | −1 | 047687–048829 | 380 | | | | | | | hyp. 41.8 kd protein |
| y4cG | | +2 | 049361–050278 | 305 | 16-173 | Pin | 184 | K00676 | 50 | 68 | prob. DNA invertase "resolvase-type" |
| | | | | | 17-222 | Y4IS | 183 | this work | 40 | 60 | |
| Y4cH | | −2 | 050427–050636 | 69 | 4-65 | CspS | 70 | L23115 | 56 | 70 | prob. cold shock regulator |
| y4cI | | −2 | 053202–054416 | 404 | 1-397 | RepC | 405 | X04833 | 60 | 73 | put. replication protein C |
| y4cJ | | −3 | 054571–055551 | 326 | 1-317 | RepB | 319 | X89447 | 39 | 55 | put. replication protein B |
| y4cK | | −2 | 055608–056831 | 407 | 10-404 | RepA | 398 | X89447 | 58 | 73 | put. replication protein A |
| y4cL | tra1 | +2 | 057635–058261 | 208 | 1-206 | TraI | 212 | U43675 | 55 | 66 | prob. autoinducer synthetase (inv. in control of conjugal transfer) |
| y4cM | trbB | +3 | 058272–059249 | 325 | 3-325 | TrbB | 323 | U43675 | 80 | 88 | prob. conjugal transfer protein |
| | | | | | 1–115 | Y4oG | 125 | this work | 25 | 51 | (PulE family) |
| y4cN | trbC | +1 | 059239–059622 | 127 | 7-127 | TrbC | 134 | U43675 | 69 | 78 | prob. conjugal transfer protein (integral membrane prot.) |
| y4cO | trbD | +2 | 059615–059914 | 99 | 1-99 | TrbD | 99 | U43675 | 70 | 89 | prob. conjugal transferprotein (integral membrane prot.) |
| y4cP | trbEa | +3 | 059925–060374 | 149 | 1-136 | TrbE | 820 | U43675 | 80 | 91 | prob. conjugal transfer protein (hom. to 5' part of trbE) |
| y4cQ | trbEb | +1 | 060394–062382 | 662 | 5-659 | TrbE | 820 | U43675 | 83 | 90 | prob. conjugal transfer protein |

TABLE 3-continued

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | hom. protein length (aa)[d] | hom. protein accession no.[e] | I/ %[f] | S/ %[f] | note[g] |
|---|---|---|---|---|---|---|---|---|---|---|---|
| | | | | | | | | | | | (hom. to 3' part of trbE) |
| y4dA | trbJ | +2 | 062354–063157 | 267 | 1-107 | TrbJ | 175 | U43675 | 60 | 69 | prob. conjugal transfer protein |
| | | | | | 194-267 | | | | 71 | 79 | |
| y4dB | trbK | +1 | 063154–063351 | 65 | 5-65 | TrbK | 75 | U43675 | 40 | 56 | prob. conjugal transfer protein precurser |
| y4dC | trbL | +3 | 063345–064520 | 391 | 3-387 | TrbL | 395 | U43675 | 74 | 85 | prob. conjugal transfer protein (integral membrane prot.) |
| y4dD | trbF | +2 | 064544–065206 | 220 | 1-220 | TrbF | 220 | U43675 | 80 | 90 | prob. conjugal transfer protein |
| y4dE | trbG | +1 | 065224–066036 | 270 | 6-270 | TrbG | 284 | U43675 | 74 | 84 | prob. conjugal transfer protein precurser |
| y4dF | trbH | +1 | 066040–066486 | 148 | 1-147 | TrbH | 159 | U43675 | 55 | 68 | prob. conjugal transfer protein precurser (with lipid anchor) |
| y4dG | trbI | +3 | 066498–067793 | 431 | 1.430 | TrbI | 433 | U43675 | 66 | 79 | prob. conjugal transfer protein (integral membrane prot.) |
| y4dH | traR | +2 | 068096–68806 | 236 | 7–236 | TraR | 234 | Z15003 | 28 | 45 | prob. transriptional activator of conjugal transfer genes (LuxR family) |
| y4dI | traM | −1 | 068810–069133 | 107 | 8-101 | TraM | 102 | U43674 | 30 | 51 | prob. modulator of TraR/autoinducer-mediated activation of tra genes |
| y4dJ | | +3 | 069351–069584 | 77 | 1-67 | ORF | 84 | X16458 | 37 | 59 | hyp. transcriptional regulator (PbsX family); low similarity to N-terminus of Y4dL |
| y4dK | | −1 | 069629–069949 | 106 | | | | | | | hyp. 11.8 kd protein |
| fd1 | | −2 | 069936–070250 | (105) | (2-85) | ORFA | 400 | X67861 | 39 | 58 | put. transposase fragment |
| y4dL | | +1 | 070603–071193 | 196 | — | — | — | — | — | — | hyp. 21.8 kd protein; low similarity to Y4dJ |
| y4dM | | +2 | 071186–072415 | 409 | 1-357 | HipA | 440 | M61242 | 31 | 46 | hyp. 45.3 kd protein; homolog affects frequency |
| | | | | | 3-405 | Y4mE | 420 | this work | 34 | 56 | of persistence after inhibition of cell wall or DNA synthesis |
| y4dN | | +1 | 072787–072975 | 62 | — | — | — | — | — | — | hyp. 7 kd protein |
| y4dO | | −1 | 073550–073951 | 133 | 12-121 | ORF | 38.1 | D83536 | 43 | 57 | hyp. 14.9 kd (fragmentous?) protein; homology to intron protein of *P. anserina* continues in fr.-2 (73541–73467) |
| y4dP | | −1 | 074423–075025 | 200 | 1-48 | ORFR2 | 57 | U43674 | 72 | 89 | hyp. 21 kd protein; hom. to |
| | | | | | 56-198 | ORFR3 | 154 | | 47 | 71 | conjugal transfer region 1 |
| y4dQ | traB | −2 | 075042–076205 | 387 | 1–387 | TraB | 421 | U40389 | 61 | 72 | prob. conjugal transfer protein |
| y4dR | traF | −3 | 076195–076761 | 188 | 20-188 | TraF | 176 | U40389 | 55 | 73 | prob. conjugal transfer protein |
| y4dS | traA | −2 | 076758–080066 | 1102 | 1-1102 | TraA | 1100 | U43674 | 67 | 79 | prob. conjugal transfer protein (relaxase) |
| y4dT | traC | +3 | 080319–080627 | 102 | 1-102 | TraC | 98 | U40389 | 64 | 80 | prob. conjugal transfer protein |
| y4dU | traD | +1 | 080632–080847 | 71 | 1-71 | TraD | 71 | U43674 | 77 | 84 | prob. conjugal transfer protein |
| y4dV | traG | +2 | 080834–082756 | 640 | 1-631 | TraG | 658 | U40389 | 71 | 83 | prob. conjugal transfer protein |
| fd2 | | + | 083002–083293 | | | ORFL1 | 152 | U43674 | | | fragments hom. to ORFL 1 (conjugal transfer region 1); frameshifts: 83072 (1 > 3), 83161 (3 > 2) |

TABLE 3-continued

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | hom. protein length (aa)[d] | hom. protein accession no.[e] | I/%[f] | S/%[f] | note[g] |
|---|---|---|---|---|---|---|---|---|---|---|---|
| y4dW | | +1 | 083305–083919 | 204 | | | | | | | hypothetical 22.9 kd protein |
| y4dX | | +1 | 083944–84522 | 192 | | | | | | | hypothetical 20.6 kd protein |
| ydeA | | −2 | 084570–084836 | 88 | | | | | | | hypothetical 9.9 kd protein |
| ydeB | | −2 | 084976–085290 | 104 | | | | | | | hypothetical 11.6 kd protein |
| fe1 | | – | 085829–088007 | | | MerA | 474 | X65467 | | | put. fragments; homology to mercuric reductase, put. frameshifts: 86592 (−1<−3), 87288 (−3<−2) |
| y4eC | | −2 | 088305–089228 | 307 | 14–306 | TraC-1 | 1061 | X59793 | 38 | 55 | hyp. 34.2 kd protein; hom. to 5' end. of traC-1 from plasmid RP4 |
| y4eD | | +1 | 091051–092178 | 375 | 51-136 | ORF145 | 145 | X52594 | 29 | 55 | put. phosphodiesterase; low homology to glycerophosphoryl-diester-phosphodiesterase |
| y4eE | | +1 | 092212–093288 | 358 | | | | | | | hyp. 38.5 kd protein |
| fe2 | | – | 093572–093969 | | | TrpA | | U14952 | | | (fragments of put. transposase; put. frameshift; 93798 (2>3) |
| y4eF | | −1 | 093980–094735 | 251 | 2-236 | Int | 259 | U14952 | 37 | 53 | put. integrase/recombinase |
| | | | | | 1-251 | Y4qK | 308 | this work | 92 | 94 | ("phage-type"); similar to Y4rF (35% aa-id.); low similarity to Y4rABCDE |
| fe5 | | −1 | 094988–095188 | 66 | 1-66 | Fq6 | 66 | this work | 79 | 94 | put. defective integrase/recombinase |
| | | | | | 1-66 | Y4rC | 332 | this work | 41 | 55 | |
| fe3 | | – | 095343–096025 | | | Int | 259 | U14952 | | | fragments hom. to integrase; put. frameshift: 95559–95671 (−2<−1) |
| y4eH | nolL | −2 | 096093–097193 | 366 | 11-359 | NolL | 373 | U22899 | 63 | 77 | nodulation protein; hyp. acetyl transferase |
| y4eI | | −2 | 097914–098225 | 103 | ! | | | | | | hyp. 11.1 kd protein with transmembrane domain |
| fe6 | | +3 | 098358–098657 | 99 | 3-98 | AatB | 410 | L12149 | 40 | 55 | hyp. 10.3 kd protein fragment, hom. to C-terminal part of bacterial aminotransferases |
| y4eK | | +2 | 098675–099421 | 248 | 10-245 | Adh | 252 | U00084 | 37 | 53 | hyp. short chain type dehydrogenase/reductase |
| y4eL | | +3 | 099447–100193 | 248 | 1-244 | Gno | 256 | X80019 | 31 | 47 | hyp. short chain type dehydrogenase/reductase |
| fe4 | | + | 100270–101901 | | | IlvG | | M37337 | | | put. fragment; put. frameshifts: 100721 (1 < 2), 101728 (2 > 1) |
| fe7 | | −1 | 101585–102298 | 237 | 1-103 | Tnp | 398 | U08627 | 91 | 95 | put. truncated transposase-like protein; similar to Y4pO |
| y4eN | | −3 | 102625–102936 | 103 | | | | | | | hyp. 11.5 kd protein |
| y4eO | | −2 | 102933–103598 | 221 | | | | | | | hyp. 24.5 kd protein |
| y4fA | | −1 | 103805–106342 | 845 | 327-837 | MepA | 657 | X66502 | 41 | 59 | prob. methyl-accepting |
| | | | | | 7-845 | Y4sI | 756 | this work | 29 | 49 | chemotaxis protein |
| y4fB | | +3 | 106620–108614 | 664 | | | | | | | hyp. 73.7 kd protein |
| y4fC | | +3 | 109884–110618 | 244 | 10-163 | DszA | 453 | L37363 | 38 | 52 | hyp. (fragmentous?) monooxygenase; |

TABLE 3-continued

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | hom. protein length (aa)[d] | hom. protein accession no.[e] | I/ %[f] | S/ %[f] | note[g] |
|---|---|---|---|---|---|---|---|---|---|---|---|
| | | | | | | | | | | | extended homology to DszA in fr.2: 110372 to 110506. |
| y4fD | | −1 | 110516–111178 | 220 | | | | | | | hyp. 24.6 kd integral membrane protein |
| y4fE | | −2 | 111195–111677 | 160 | | | | | | | hyp. 17.2 kd protein precurser |
| y4fF | | −1 | 111803–112348 | 181 | | | | | | | hyp. 19.5 kd protein |
| y4fG | | −2 | 112338–112727 | 129 | | | | | | | hyp. 14.5 kd protein |
| y4fH | | −1 | 113474–113782 | 102 | | | | | | | hyp. 11.6 kd protein |
| ff1 | | −3 | 113779–114114 | 111 | 61-97 | DppF | 330 | L08399 | 56 | 86 | hyp. protein fragment, similar to central region of oligo/di-peptide ABC transporter ATP-binding proteins |
| y4fJ | | −2 | 114348–115379 | 343 | 3–210 | RopA | 318 | M69214 | 53 | 66 | put. outer membrane protein (point) precurser |
| y4fK | | −2 | 116112–117395 | 427 | 275-421 | XyIS2 | 157 | L02642 | 31 | 53 | put. transcriptional regulator (AraC family) |
| y4fL | | −3 | 117385–118212 | 275 | 9–243 | ORF | 268 | U39059 | 32 | 46 | hyp. 29.1 kd integral membrane protein, belongs to the inositol monophosphatase family |
| y4fM | | −2 | 118209–119144 | 311 | | | | | | | hyp. 35.5 kd protein |
| y4fN | | −2 | 119145–120854 | 569 | 11-513 | CysU | 550 | U32807 | 23 | 45 | prob. ABC transporter permease protein; put. part of binding- -protein-dependent transport system Y4fNOP |
| y4fO | | −1 | 120851–121870 | 339 | 12-247 | PotA | 381 | U32759 | 49 | 68 | prob. ABC transporter AtP- binding protein |
| y4fP | | −1 | 121883–122959 | 358 | 32–293 | SufA | 338 | M33815 | 23 | 42 | prob. ABC transporter periplasmic binding protein precurser |
| y4fQ | | +1 | 123016–124194 | 392 | 9–234 | NagC | 406 | X14135 | 25 | 46 | hyp. 41.6 kd protein; belongs to "ROK" family (transcriptiotial regulator or transferase) |
| y4fR | | +1 | 124813–126453 | 546 | 88-539 | JpaH | 532 | M32063 | 38 | 54 | hyp. 60.5 kd protein, hom. to invasion plasmid antigen H |
| y4gA | | −1 | 126806–127369 | 187 | | | | | | | hyp. 20.9 kd protein; low similarity to Y4rE |
| y4gB | | −2 | 127485–127904 | 139 | | | | | | | hyp. 16.1 kd protein |
| y4gC | | −1 | 127901–128479 | 192 | 1-178 | ORF2 | 415 | L34580 | 43 | 58 | put. integrase/recombinase ("phage-type) |
| y4gD | | −1 | 128579–128857 | 92 | | | | | | | hyp. 10.5 kd protein |
| y4gE | | +2 | 131021–131767 | 248 | | | | | | | hyp. (fragmentous?) 27.7 kd protein; put. frameshifts: 131532 (2>1), 131892 (1>2) |
| y4gF | | +2 | 132734–133786 | 350 | 4-345 | RhsB | 353 | U51197 | 65 | 74 | prob. dTDP-D-glucose-4,6- dehydratase (Y4gFGH inv. in dTDP-L-rhamnose biosynthesis) |
| y4gG | | +2 | 133790–134680 | 296 | 1-290 | RhsD | 288 | U51197 | 48 | 66 | prob. dTDP-4-dehydrorhamnose reductase |
| y4gH | | +1 | 134677–135537 | 286 | 2-285 | RfbA | 293 | U09876 | 65 | 82 | prob. glucose-1-phosphate thymidylyltransferase |

TABLE 3-continued

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | hom. protein length (aa)[d] | hom. protein accession no.[e] | I/%[f] | S/%[f] | note[g] |
|---|---|---|---|---|---|---|---|---|---|---|---|
| y4gI | | +3 | 135534–138263 | 909 | 276-894 | RfbC | 1275 | U36795 | 38 | 55 | hyp. 102.8 kd protein (homolog is involved in O-antigen biosynthesis) |
| y4gJ | | −1 | 138737–139315 | 192 | | | | | | | hyp. 21.1 kd protein |
| y4gK | fixF | +3 | 142026–143234 | 402 | 114-184 | KpsS | 389 | X74567 | 26 | 54 | necessary for functional nitrogen |
| | | | | | 203-362 | | | | 30 | 53 | fixation, hom. to capsule polysaccharide export protein |
| y4gL | | −3 | 143473–144060 | 195 | 24-192 | RhsC | 188 | U51197 | 53 | 65 | prob. dTDP-4-dehydrohamnose-3,5-epimerase (inv. in dTDP -L-rhamnose biosynthesis) |
| y4gM | | −2 | 144147–145907 | 586 | 26-581 | MsbA | 582 | Z11796 | 32 | 56 | prob. ABC transporter ATP-binding protein |
| y4gN | | +2 | 146075–147226 | 383 | 52-297 | VirA | 304 | L08012 | 29 | 46 | hyp. 45 kd protein |
| y4hA | | −1 | 147455–148558 | 367 | 7–362 | ChaA | 366 | L28709 | 34 | 58 | put. ionic transporter |
| y4hB | noeE | −3 | 148819–150078 | 419 | 3-138 | F42G9.8 | 359 | U00051 | 32 | 49 | nodulation protein (put. |
| | | | | | 197–289 | | | | 25 | 50 | sulfate transferase) |
| y4hC | noeG | −3 | 151051–151782 | 243 | 18–229 | u0002kb | 243 | U00024 | 27 | 42 | nodulation protein (unknown function) |
| y4hD | nolO | −1 | 151979–154021 | 680 | 1-126 | NolN | 127 | L22756 | 70 | 83 | inv. in O-carbamoylation of |
| | | | | | 140-496 | NolO | 358 | | 78 | 89 | Nod factors (sim. to NodU) |
| y4hE | zodJ | −3 | 154120–154908 | 262 | 5–261 | NodJ | 262 | J03685 | 69 | 84 | prob. ABC transporter permease (see nodI) |
| y4hF | nod1 | −3 | 154912–155943 | 343 | 15–343 | NodI | 339 | X55795 | 69 | 85 | prob. ABC transporter ATP-binding transport protein; put role; together with NodJ export of modified beta-1,4 N-glucosamine oligosaccharides |
| y4hG | nodC | −1 | 156095–157336 | 413 | 1-413 | NodC | 413 | X73362 | 99 | 100 | N-acetylglucosaminyltransferase |
| y4hH | nodB | −3 | 157351–157998 | 215 | 1-215 | NodB | 214 | X73362 | 99 | 99 | chitooligosaccharide deacytelase |
| v4hI | nodA | −2 | 579951–158585 | 196 | 1-196 | NodA | 196 | X73362 | 100 | 100 | N-acyltransferase; nodABC involved in synthesis of backbone of modified N-acylated glucosamine oligosaccharides |
| y4hJ | | −1 | 158993–159775 | 260 | 59-240 | ORF2 | 251 | L133618 | 68 | 81 | hom. to part of coproporphyrinogenIII oxidase (lacks C-terminus and conserved N-term. domain) |
| y4hK | | +3 | 160722–161465 | 247 | | | | | | | hyp. 25.4 kd internal membrane protein |
| y4hL | | +1 | 161569–161826 | 85 | | | | | | | hyp. 9.6 kd protein |
| y4hM | | +1 | 163042–164253 | 403 | 53-169 | Gfor | 439 | M97379 | 31 | 54 | hyp. 43.9 kd protein (partially hom. to glucose-fructose oxidoreductase) |
| y4hN | | +2 | 164600–165034 | 144 | 10-144 | ORFA | 135 | X84099 | 38 | 53 | hyp. 16 kd protein; partiaily hom. to Y4jB and Y4rG |
| y4hO | | +1 | 165037–165384 | 115 | 1-115 | ORF140 | 140 | X74068 | 100 | 100 | hyp. 12.8 kd protein |
| | | | | | 1-115! | ORFC | 144 | X84099 | 54 | 69 | |
| | | | | | 1-115 | Y4jC | 117 | this work | 36 | 62 | |
| y4hP | | +1 | 165430–167088 | 552 | 1-215 | no1265 | 266 | X74068 | 97 | 97 | hyp. 61.7 kd protein; similar to |
| | | | | | 80–328 | ORF2 | 258 | M10204 | 67 | 79 | Y4aQ, Y4jD and Y4qI |

TABLE 3-continued

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | length (aa)[d] | accession no.[e] | I/ %[f] | S/ %[f] | note[g] |
|---|---|---|---|---|---|---|---|---|---|---|---|
| | | | | | 162-492 | ORF3 | 163 | M10204 | 47 | 61 | |
| y4hQ | | +3 | 167091–167675 | 194 | 5-185 | ORF3 | 237 | X51418 | 35 | 53 | hyp. 21.7 kd protein |
| | | | | | 1-52 | ORF91 | >91 | X74068 | 96 | 98 | |
| y4hR | | −3 | 167710–167934 | 74 | | | | | | | hyp. 8.8 kd protein |
| fi1 | | −1 | 168208–168300 | | | | | | | | hyp. transposase fragment similar to |
| | | | | | | | | | | | *R. meliloti* ISRm2011-2 |
| fi2 | | +1 | 168430–168792 | 120 | 1-130 | Y4iO | 252 | this work | 78 | 87 | put. defective transposase (homologous |
| | | | | | 1-108 | Y4rJ | 396 | this work | 74 | 87 | to N-terminal |
| | | | | | | | | | | | parts of Y4iO and Y4rJ) |
| fi3 | | +2 | 168798–169190 | 130 | 1-109 | ORF1A | 317 | M33159 | 37 | 55 | put. defective transposase(hom.to C- |
| | | | | | 1-130 | Y4iO | 252 | this work | 78 | 87 | terminal parts of Y4iO and Y4rJ); |
| | | | | | 1-130 | Y4rJ | 396 | this work | 76 | 84 | additionally weak homology to |
| | | | | | | | | | | | Y4pF/Y4sB and Y4qE (<30% identity) |
| y4iR | | −3 | 169231–169716 | 161 | 15-145 | PsiB | 134 | L26581 | 55 | 74 | hyp. protein (homolog located in a poly- |
| | | | | | | | | | | | saccharide biosynthesis inhibition operon |
| y4iC | | −2 | 169929–170621 | 230 | 58-123 | ORF | 161 | Z73419 | 41 | 54 | hyp. 25.8 kd protein |
| | | | | | | | | | | | (ORF=MTCY373.06) |
| y4iD | | −3 | 170563–172551 | 662 | 137-342 | ORF | 495 | Z73101 | 40 | 59 | prob. monooxygenase (ORF=MTCY31.20) |
| | | | | | 418-605 | | | | 28 | 51 | |
| y4iE | | +3 | 173295–173702 | 135 | 1-135 | Y4rL | 155 | this work | 33 | 52 | hyp. 15.4 kd (fragmentous?) protein; |
| | | | | | | | | | | | similar.to Y4ZA |
| y4iF | | −3 | 174211–175128 | 305 | | | | | | | hyp. 34.1 kd protein |
| y4iG | | −2 | 175590–175862 | 90 | 1-73 | Y4aT | 266 | this work | 93 | 97 | hyp. 10.5 kd (fragmentous?) protein |
| | | | | | 1-73 | Y4bF | 457 | this work | 60 | 76 | |
| y4iH | | +2 | 176045–176764 | 239 | 1–236 | Y4jT | 336 | this work | 32 | 53 | hyp. 26 kd protein precurser |
| y4iI | | −2 | 176937–179048 | 703 | | | | | | | hyp. 76.2 kd integral membrane protein |
| y4iJ | | −2 | 179097–180887 | 596 | | | | | | | hyp. 65.5 kd protein; |
| | | | | | | | | | | | low similarity to Y4iM |
| y4iK | | −3 | 180940–181638 | 232 | | | | | | | hyp. 26.8 kd protein; y4iKL: |
| | | | | | | | | | | | two fragments of one gene?; |
| | | | | | | | | | | | put. frameshift: 181884 (−3<−2) |
| y4iL | | −2 | 181692–182990 | 432 | | | | | | | hyp. 47.8 kd protein; y4iKL two fragments |
| | | | | | | | | | | | of one gene?; put. |
| | | | | | | | | | | | frameshift: 181884 (−3<−2) |
| y4iM | | −2 | 183036–184334 | 432 | | | | | | | hyp. 47.1 kd protein; low similarity to Y4iJ; y4iMN |
| | | | | | | | | | | | two fragments of one gene?; |
| | | | | | | | | | | | put. frameshift: 184440 (−2<−3) |
| y4iN | | −3 | 184309–184935 | 208 | | | | | | | hyp. 22.1 kd protein precurser; y4iMN two fragments |
| | | | | | | | | | | | of one gene?; put. frameshift: |
| | | | | | | | | | | | 184440 (−2<−3) |
| y4iO | | −2 | 185679–186437 | 252 | 17–243 | Tnp | 334 | Z48244 | 29 | 46 | put. transposase or transposase- |
| | | | | | 1-121 | Fi2 | 120 | this work | 67 | 79 | fragment; additionally |
| | | | | | 123-252 | Fi3 | 130 | this work | 78 | 87 | weak homology to Y4pF/ |
| | | | | | 1-252 | Y4rJ | 396 | this work | 71 | 83 | /Y4sB and Y4qE (<30% identity) |

TABLE 3-continued

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | hom. protein length (aa)[d] | hom. protein accession no.[e] | I/ %[f] | S/ %[f] | note[g] |
|---|---|---|---|---|---|---|---|---|---|---|---|
| y4iP | | −1 | 186437–186832 | 131 | 4-163 | Y4rJ | 396 | this work | 58 | 80 | hyp. 14.4 kd protein or fragment hom. to N-term. of Y4rJ |
| y4iQ | | −3 | 187162–188058 | 298 | 13–253 | IstB | 265 | U38187 | 34 | 56 | identical to Y4nD/Y4sD; put. inser- |
| | | | | | 8–283 | Y4bM | 263 | this work | 31 | 56 | tion sequence ATP-binding protein; |
| | | | | | 5–265 | Y4uH | 248 | this work | 31 | 52 | similarity to Y4bM/Y4kI/Y4tA, Y4uH and weakly to Y4PL |
| y4jA | | −2 | 188055–189569 | 504 | 147-494 | IstA | 507 | U38187 | 25 | 42 | identical to y4nE/y4sE; hyp. 57.2 kd |
| | | | | | 395-504 | Fz4 | 110 | this work | 72 | 85 | protein with low similarity to IS21/IS408/IS1162 transposases |
| y4jB | | +3 | 190248–190706 | 152 | 24-79 | ORF1 | 130 | U19148 | 46 | 69 | hyp. 16.7 kd protein; partially similarity Y4hN; low similarity to Y4rG |
| y4jC | | +2 | 190703–191056 | 117 | 1-115 | ORFC | 144 | X84099 | 39 | 58 | hyp. 13.1 kd protein; see y4hO |
| | | | | | 1-117 | Y4hO | 115 | this work | 36 | 62 | |
| y4jD | | +2 | 191105–192640 | 511 | 89-298 | ORF2 | 258 | M10204 | 36 | 53 | hyp. 56.7 kd protein: see y4hP |
| | | | | | 340-453 | ORF3 | 163 | M10204 | 28 | 49 | |
| | | | | | 18-183 | no1265 | 266 | X74068 | 32 | 48 | |
| y4jE | | +1 | 192637–193458 | 273 | | | | | | | hypothetical (fragmentous?) 29.4 kd integral membrane protein; put. frameshift: 192996 (1>2; end of shifted ORF at 193183) |
| y4jF | | −1 | 194771–196330 | 519 | | | | | | | hyp. 55.4 kd integral membrane protein |
| y4jG | | −3 | 196333–196821 | 162 | | | | | | | hyp. 17.9 kd transmembrane protein |
| y4jH | | −2 | 196818–197435 | 205 | | | | | | | hyp. 23 kd protein |
| y4jI | | −3 | 197428–197820 | 130 | | | | | | | hyp. 13.6 kd protein |
| y41J | | +1 | 198043–198300 | 85 | 1-85 | StbC | 103 | L48985 | 67 | 76 | put. plasmid stability protein |
| y4jK | | +3 | 198297–198719 | 140 | 1-138 | StbB | 139 | L48985 | 57 | 76 | put. plasmid stabiiity protein |
| y4jL | | +3 | 199002–199664 | 220 | | | | | | | hyp. 25.1 kd protein |
| y4jM | | −2 | 199746–199958 | 70 | 1-58 | Y4bF | 457 | this work | 75 | 79 | hyp. 8 kd protein or protein fragment |
| | | | | | 15-58 | fb1 | 188 | this work | 50 | 64 | |
| y4iN | | −3 | 199975–200415 | 146 | | | | | | | hyp. 16.3 kd protein |
| y4jO | | −3 | 201514–202479 | 321 | | | | | | | hyp. 36.1 kd protein; y4jOP: two fragments of one gene?, put. frameshift: 202550 (−3<−1) |
| y4jP | | −1 | 202406–203194 | 262 | | | | | | | hyp. 29.5 kd protein; y4jOP: two fragments of one gene?, put. frameshift: 202550 (−3<−1) |
| y4iQ | | +2 | 203729–206848 | 1039 | | | | | | | hyp. 115.9 kd protein |
| y4iR | | +1 | 206860–207315 | 151 | | | | | | | hyp. 17.3 kd protein |
| y4iS | | +1 | 207316–208557 | 413 | | | | | | | hyp. 44.8 kd protein |
| y4iT | | −1 | 208877–209887 | 336 | 17–283 | Y4iH | 239 | this work | 32 | 53 | hyp. 36.4 kd protein precurser |
| y4kA | | −3 | 209917–210885 | 322 | | | | | | | hyp. 36.7 kd protein |
| y4kB | | +1 | 211663–212088 | 141 | | | | | | | hyp. 15.2 kd integral membrane protein |
| fk2 | | −1 | 212111–212479 | 122 | 58-116 | ORFl4 | 104 | X00493 | 59 | 76 | hyp. fragment; sim. to Y4hP, Y4jD and Y4qI; additional homology to ORF14 in fr. +3/+2: 212331–212509 |

TABLE 3-continued

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | hom. protein length (aa)[d] | hom. protein accession no.[e] | I/ %[f] | S/ %[f] | note[g] |
|---|---|---|---|---|---|---|---|---|---|---|---|
| y4kD | | −1 | 212750–214399 | 549 | | | | | | | hyp. 60.4 kd protein |
| y4kE | | −1 | 214412–215455 | 347 | | | | | | | hyp. 38 kd protein; y4kEF: two fragments of one gene?, put. frameshift: 215616 (−1<−2) |
| y4kF | | −2 | 215439–216743 | 434 | | | | | | | hyp. 47.4 kd protein; y4kEF: two fragments of one gene?, put. frameshift: 215616 (−1<−2) |
| y4kG | | −2 | 216855–217064 | 69 | | | | | | | hyp. 7.7 kd protein |
| y4kH | | −3 | 217105–217488 | 127 | | | | | | | hyp. 14.1 kd protein |
| y4kI | | −1 | 217670–218461 | 263 | — | — | — | — | — | — | see y4bM |
| y4kJ | | −3 | 218458–220008 | 516 | — | — | — | — | — | — | see y4bL |
| y4kK | | −1 | 220103–221041 | 312 | | | | | | | hyp. 34.9 kd protein |
| y4kL | | −2 | 221049–222041 | 330 | 101-296 | ORF300 | 300 | U23723 | 39 | 56 | hyp. 37.6 kd AAA-family ATPase protein |
| y4kM | | +2 | 222641–222994 | 117 | | | | | | | hyp. 13.1 kd protein |
| y4kN | | +2 | 223115–223537 | 140 | | | | | | | hyp. 15.7 kd protein |
| y4kO | | +2 | 223970–224218 | 82 | | | | | | | hyp. 9.2 kd protein |
| y4kP | | +1 | 224215–224505 | 96 | | | | | | | hyp. 11 kd protein |
| y4kQ | | −2 | 224898–225326 | 142 | | | | | | | hyp. (fragmentous?) 15.3 kd protein; homology to hipO fragments on the complementary strand |
| fk1 | | +3 | 225094–225473 | | | | | Z36940 | | | fragments hom. to hipO |
| y4kR | | −3 | 225535–225666 | 43 | 1-36 | ORF6 | 347 | M87280 | 55 | 66 | hyp. 4.8 kd (fragmentous?) protein (smallest ORF predicted to be a protein); hom. to N-term. of protein in crtE-crtX intergenic region |
| y4kS | | −3 | 225751–226656 | 301 | 1-301 | ORF8 | 300 | U12678 | 93 | 94 | hyp. 33.2 kd protein |
| y4kT | | −2 | 226653–228203 | 516 | 1-516 | ORF7 | 516 | U12678 | 93 | 94 | hyp. 55.1 kd protein |
| y4kU | | −3 | 228514–229512 | 332 | 1-332 | ORF6 | 332 | U12678 | 90 | 94 | prob. geranyltranstransferase |
| y4kV | | −3 | 229666–231009 | 447 | 92-447 | CYP117 | 356 | U12678 | 89 | 94 | cytochrome P450 BJ-4 homolog |
| y4lA | | −2 | 231009–231845 | 278 | 1-274 | ORF4 | 275 | U12678 | 83 | 87 | short-chain type dehydrogenase/reductase |
| yrlB | | −3 | 231832–232140 | 102 | 1-58 | ORF3 | 94 | U12678 | 93 | 98 | put. P450-system 3Fe-3S ferredoxin |
| y4lC | | −2 | 232170–233573 | 467 | 48-428 | CYP114 | 382 | U12678 | 90 | 93 | cytochrome P-450 BJ-3 homolog |
| y4lD | | −1 | 233666–234868 | 400 | 3-400 | CYP112 | 401 | U12678 | 92 | 95 | cytochrome P-450 BJ-1 homolog |
| fl3 | | −2 | 235704–235904 | 66 | 2-54 | ORF8 | >207 | X66124 | 60 | 71 | hyp. 7.6 kd protein fragment, homology to ORF8 fragments also upstream of fl3 up to 236048 |
| fl1 | | – | 236796–237416 | | | | | Z36981 | | | homology to hupK/hupJ fragments (fr. −3/−2) |
| y4lF | | +1 | 237508–238479 | 323 | | | | | | | hyp. 36.1 kd protein |
| y4lG | | +2 | 238490–238975 | 161 | | | | | | | hyp. 17.4 kd protein |
| y4lH | | −2 | 238959–239537 | 192 | 3-184 | Fic | 200 | M28363 | 34 | 51 | hyp. 22.4 kd protein; hom. to cell filamentation/division protein |
| y4lI | | −2 | 239541–239750 | 69 | | | | | | | hyp. 7.3 kd protein |
| y4lJ | | −3 | 240358–240861 | 167 | | | | | | | hyp. 18.1 kd protein |
| fl2 | | – | 240920–241040 | | | | | X65471 | | | fragments of transposase (ISRm4) |

TABLE 3-continued

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | hom. protein length (aa)[d] | hom. protein accession no.[e] | I/ %[f] | S/ %[f] | note[g] |
|---|---|---|---|---|---|---|---|---|---|---|---|
| y4lK | | +1 | 241207–241605 | 132 | | | | | | | hyp. 14.3 kd protein |
| y4lL | | −2 | 241845–244328 | 827 | 118-816 | SLR0359 | 1244 | D63999 | 33 | 50 | hyp. 91.8 kd protein (member of *E. coli* YegE/YhdA/YhjK/YicC family) |
| fl4 | | +1 | 244540–244851 | 103 | 19-103 | TnpA | 990 | L14931 | 39 | 51 | put. truncated transposase; hom. to N-term. of TnpA (transposon Tn163); strong similarity to to *C-terminus* of F15 |
| | | | | | 28-81 | F15 | 112 | this work | 94 | 98 | |
| Y4lN | | +3 | 244848–245330 | 160 | | | | | | | hyp. 18.1 kd protein |
| y4lO | | −3 | 247156–247938 | 260 | 11-216 | AvrRxv | 373 | L20423 | 36 | 50 | hyp. 29.1 kd protein; hom. to avirulence protein; put, frameshift according to homolog: 247230–247293 (−2<−3): end of shifted frame: 246960 |
| fl5 | | +1 | 248290–248628 | 112 | 59-112 | F14 | 103 | this work | 94 | 98 | hyp. protein fragment; strong similarity to part of F14 |
| fl6 | | +3 | 248814–249680 | 288 | 8-286 | Tnp | 988 | M97297 | 27 | 49 | put. fragmentous transposase; homologous C-term. of transposase (Tn1546) |
| y4lR | | +3 | 249696–251264 | 522 | | | | | | | hyp. 56.8 kd protein |
| y4lS | | +1 | 251407–251958 | 183 | 3-176 | PaeR7IN | 195 | S78872 | 42 | 56 | put. integrase/recombinase ("resolvase-type") |
| | | | | | 4-181 | Y4cG | 305 | this work | 40 | 60 | |
| y4mA | | +3 | 251955–252380 | 141 | | | | | | | hyp. 15.8 kd protein |
| fm1 | | – | 254694–254920 | | | | | | | | fragments hom. to xylitol-dehydrogenase |
| y4mB | | +3 | 255450–256139 | 229 | 59–229 | ORF4 | 212 | X13583 | 33 | 53 | hyp. 24.6 kd outer membrane protein precurser |
| y4mC | | +2 | 256811–257524 | 237 | | | | | | | hyp. 26.2 kd protein precurser |
| y4mD | | −1 | 258065–258334 | 89 | | | | | | | hyp. 10 kd protein |
| y4mE | | −3 | 259030–260292 | 420 | 6-334 | HipA | 440 | M61242 | 32 | 46 | hyp. 45.7 kd protein |
| | | | | | 2-417 | Y4dM | 409 | this work | 34 | 56 | |
| y4mF | | −2 | 260289–260519 | 76 | 11-47 | ORF3 | 90 | X06090 | 37 | 70 | hyp. transcriptional regulator; very low similarity to phage repressor proteins |
| y4mG | | +3 | 261174–261395 | 73 | | | | | | | hyp. 7.8 kd protein |
| y4mH | | −2 | 261747–262640 | 297 | | | | | | | hyp. 33.9 kd protein |
| y4mI | | −2 | 262698–263672 | 324 | 11-252 | RbsB | 296 | M13169 | 25 | 49 | prob. ABC transporter periplasmic binding protein precurser (transport system Y4mIJK probably transports a sugar) |
| y4mJ | | −3 | 263716–264717 | 333 | 12-323 | RbsC | 321 | M13169 | 34 | 55 | prob. ABC transporter permease |
| y4mK | | −2 | 264714–266207 | 497 | 8-489 | RbsA | 501 | M13169 | 34 | 55 | prob. ABC transporter ATP-binding protein |
| y4mL | | −3 | 266218–267477 | 419 | 1-418 | HI1029 | 425 | U00079 | 33 | 58 | put. permease (*E. coli* YiaN/YgiK family) |
| y4mM | | −2 | 267474–269099 | 541 | 38-360 | HI1028 | 328 | U32729 | 33 | 54 | put. permease (SBR family 7) |
| y4mN | | −1 | 269096–270133 | 345 | 37–340 | Tkt | 655 | U09256 | 36 | 54 | hyp. transketolase family protein (fragmentous?); hom. to C-term. of transketolases |

TABLE 3-continued

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | hom. protein length (aa)[d] | hom. protein accession no.[e] | I/ %[f] | S/ %[f] | note[g] |
|---|---|---|---|---|---|---|---|---|---|---|---|
| y4mO | | −3 | 270130–270969 | 279 | 9–270 | Tkt | 655 | U09256 | 36 | 52 | hyp. transketolase family protein (fragmentous?); hom. to N-term. of transketolases |
| y4mP | | −3 | 271000–271761 | 253 | 4–249 | F09E10.3 | 255 | U41749 | 41 | 60 | put. short-chain type dehydrogenase/reductase |
| y4mQ | | +1 | 271909–272805 | 298 | 1-289 | PerR | 297 | U57080 | 48 | 65 | hyp. transcriptional regulator (LysR family) |
| y4nA | | −2 | 273204–275384 | 726 | 45-302 | ORF | 690 | D14005 | 21 | 36 | prob. peptidase; very low similarity to |
| | | | | | 365-718 | | | | 38 | 54 | Y4qF and Y4sO (<25% identity) |
| y4nB | nodU | −3 | 276451–278127 | 558 | 1-558 | NodU | 558 | X89965 | 100 | 100 | inv. in 6-O-carbamoylation of Nod factors; similar to Y4hD |
| y4nC | nodS | −1 | 278144–278794 | 216 | 1-216 | NodS | 216 | J03686 | 100 | 100 | methyltransferase inv. in Nod-factor synthesis |
| y4nD | | −3 | 280453–281349 | 298 | — | — | — | — | — | — | see Y4iQ |
| y4nE | | −2 | 281346–282860 | 504 | — | — | — | — | — | — | see Y4jA |
| fn1 | | + | 283238–283467 | | | | 241 | M26938 | | | hom. to virG fragments; similar to fq3 |
| y4nF | | +3 | 283809–284501 | 230 | | | | | | | hyp. 25.4 kd protein precurser; low similarity to Y4aO (<30% id.) |
| fn2 | | - | 284752–284923 | | | | | X79443 | | | fragments hom. to ORF2 (IS-ATP-binding protein) from IS1162 |
| y4nG | | +2 | 285407–286597 | 396 | 53-365 | ORF4 | 333 | U08223 | 31 | 47 | put. NAD-dep. nucleotide sugar epimerase(dehydrogenase |
| y4nH | | +1 | 286594–286947 | 117 | 5-113 | MvrC | 110 | M62732 | 30 | 47 | hyp. 12.3 kd integral membrane protein (some similarity to ethidium bromide resistance proteins) |
| y4nI | | +2 | 286964–287326 | 120 | | | | | | | hyp. 13 kd transmembrane protein |
| y4nJ | | +1 | 287335–288852 | 505 | 80–266 | BetA | 548 | U39940 | 29 | 44 | hyp. GMC-type oxidoreductase |
| | | | | | 343-468 | | | | 32 | 45 | |
| y4nK | | −2 | 288906–290894 | 662 | | | | | | | hyp. integral membrane protein |
| y4nL | | −3 | 290914–291984 | 356 | 14-345 | ORF6 | 328 | U47057 | 26 | 45 | put. NAD dep. nucleotide sugar epimerase/dehydrogenase |
| y4nM | | −3 | 292003–293553 | 516 | 226-514 | NoeC | 307 | L18897 | 30 | 52 | put. permease |
| y4oA | | −3 | 294502–296283 | 593 | 328-494 | MccB | 350 | X57583 | 29 | 41 | hyp. 65.2 kd protein; homolog inv. in production of the |
| | | | | | 4-590 | Y4qC | 583 | this work | 30 | 50 | translation inhibitor microcin C7 |
| y4oB | | +1 | 296572–296961 | 129 | | | | | | | hyp. 14.7 kd protein |
| y4oC | | +1 | 296965–297657 | 230 | | | | | | | hyp. 26 kd protein |
| y4oD | | −1 | 297746–298390 | 214 | | | | | | | hyp. 23.5 kd protein |
| y4oE | | −3 | 298939–299148 | 69 | | | | | | | hyp. 7.4 kd protein |
| fo1 | | −2 | 299145–299588 | 147 | | | | | | | fo1 and fo2: two fragments of one put. gene; put. frameshift: 299664 (−2<−3) |
| fo2 | | −3 | 299578–299955 | 125 | 25-109 | ORF11 | 344 | X53264 | 37 | 63 | homology to 5 part of ORF11; |
| | | | | | 1-123 | Y4cM | 325 | this work | 25 | 51 | fo1 and fo2: two fragments of one putative gene; put. frameshift: 299664 (−2<−3) |
| fo3 | | +3 | 300015–300815 | 267 | 15-252 | Tnp | 518 | L09108 | 40 | 59 | fo3 and fo7: transposase-like protein interrupted by NGRIS-6 |
| fo4 | | −2 | 300828–301259 | 143 | 1-143 | Y4bA | 694 | this work | 77 | 83 | hyp. fragment; f04/5/6: fragments of one gene similar to Y4bA/Y4pH |
| fo5 | | −1 | 301274–301684 | 136 | 1-127 | Y4bA | 694 | this work | 83 | 94 | hyp. fragment; f04/5/6: fragments of one gene |

TABLE 3-continued

List of the predicted functional ORFs and of fragments representing putative remnants of functionial ORFs

| ORF[a] | func-tional name | st.[b] | position in plasmid (base no.)[c] | no. of deduced amino acids | hom. amino acids (position) | hom. protein name | hom. protein length (aa)[d] | hom. protein accession no.[e] | I/ %[f] | S/ %[f] | note[g] |
|---|---|---|---|---|---|---|---|---|---|---|---|
| fo6 | | −2 | 301608–302900 | 430 | 1-393 | Y4bA | 694 | this work | 89 | 95 | hyp. fragment; f04/5/6: fragments of one gene |
| y4oL | | −3 | 302890–303156 | 88 | 1-88 | Y4bB | 98 | this work | 63 | 69 | hyp. 9.6 kd protein |
| y4oM | | -1 | 303179–303628 | 149 | 1-149 | Y4bC | 149 | this work | 79 | 88 | hyp. 16.8 kd protein |
| y4oN | | −2 | 303810–304022 | 70 | 1-70 | Y4bD | 89 | this work | 73 | 84 | hyp. 8.1 kd protein |
| fo7 | | +2 | 304118–304453 | 111 | 4-103 | Tnp | 518 | L09108 | 40 | 59 | fo3 and fo7: transposase-like protein interrupted by NGRIS-6 |
| y4oP | | +1 | 304861–306156 | 431 | 47-429 | u1756v | 469 | U15180 | 27 | 42 | prob. ABC transporter binding protein (Y4OPQRS: sugar-like transport system) |
| y4oQ | | +2 | 306236–307165 | 309 | 31–301 | MalF | 310 | U15180 | 35 | 56 | prob. ABC transporter permease protein |
| y4oR | | +2 | 307178–308011 | 277 | 12–277 | MalG | 296 | U15180 | 30 | 52 | prob. ABC transporter permease protein |
| y4oS | | +1 | 308008–309123 | 371 | 7–369 | UgpC | 369 | U00039 | 50 | 68 | prob. ABC transporter ATP.binding protein |
| y4oT | | −2 | 309132–309722 | 196 | 2-196 | Y4pA | 609 | this work | 28 | 50 | hyp. 20.6 kd protein; homologous to N-terminus of Y4PA, and weakly to Y4oV |
| y4oU | | +1 | 309853–311061 | 402 | | | | | | | hyp. 43.1 kd protein precurser |
| y4oV | | +2 | 311051–311908 | 285 | 3-280 | Y4pA | 609 | this work | 32 | 56 | hyp. 30.2 kd protein; homologous to N-terminus of Y4PA, and weakly to Y4oT |
| y4oW | | +1 | 311911–312561 | 216 | | | | | | | hyp. 23.7 kd protein |
| y4oX | | +3 | 312606–313688 | 360 | 36-233 | MocA | 317 | X78503 | 29 | 44 | prob. NAD-dep. oxidoreductase |
| y4pA | | +1 | 313714–315543 | 609 | 310-596 | HydG | 441 | U00006 | 33 | 50 | put. transcriptional regulator (sigrra54-dep.) |
| | | | | | 6-290 | Y4oV | 285 | this work | 32 | 56 | |
| | | | | | 35-237 | Y4oT | 196 | this work | 28 | 50 | |
| y4pB | otsB | +3 | 316350–317147 | 265 | 30-260 | OtsB | 266 | X69160 | 41 | 57 | prob. trehalose-phosphate phosphatase |
| y4pC | otsA | +1 | 317185–318579 | 464 | 1-456 | OtsA | 474 | X69160 | 46 | 66 | prob. trehalose-6-phosphate synthase; similar to fq1/2 |
| fp1 | | + | 318915–319242 | | | | | U08864 | | | fragments homologous to ORF3; put. frameshift acc. to homologue: 319122 (3>1) |
| fp2 | | + | 319236–319670 | | | | | U08864 | | | fragment homologous to ORF1 from IS1248 (fr. 3); similar to fs4 |
| Y4pD | | −1 | 319601–320116 | 171 | 13-140 | Ros | 142 | M65201 | 50 | 71 | put. transcriptional regulator (MucR family); missing Zn finger motif; similar to Y4ap |
| y4pE | | −1 | 320606–321013 | 135 | 1-135 | | 222 | U18764 | 91 | 94 | identical to y4sA; hyp. 15.5 kd protein hom. to N-term. of RFRS9 2SkDa protein |
| y4pF | | −2 | 321297–322460 | 387 | 50–374 | Tnp | 334 | Z48244 | 43 | 60 | identical to y4sB; put. transposase; low similarity to Y4qE, Y4iB and Y4jO (<30% aa4d.) |
| y4pG | | −3 | 322486–323064 | 192 | 1-191! | ORFA | 197 | U22323 | 47 | 64 | identical to y4sC; hyp. 21.1 kd protein |
| fp3 | | +2 | 323189–323956 | | | | | X79443 | | | "ORF" homologous to ORF1 of ISI162 interrupted by stop codon (323444) |
| y4pH | | −1 | 323969–326053 | 694 | — | — | — | — | — | — | see y4bA |
| y4pI | | −2 | 326043–326309 | 88 | — | — | — | — | — | — | see y4bB |
| y4pJ | | −3 | 326329–326778 | 149 | — | — | — | — | — | — | see y4bC |
| y4pK | | −1 | 326969–327238 | 89 | — | — | — | — | — | — | see y4bD |
| fp4 | | +1 | 327277–328059 | | | | | LO9108 | 48 | 65 | fragment homologous to put. IS-ATP-binding protein |
| y4pL | | +3 | 328071–328808 | 245 | 1-204 | ORF2 | 231 | X79443 | 51 | 63 | put. insenion sequence ATP-binding protein: similarity to |
| | | | | | 1-242 | Y4bM | 263 | this work | 55 | 73 | Y4bM/Y4kI/Y4tA, Y4uH, and weakly to |
| | | | | | 1-245 | Y4uH | 248 | this work | 61 | 77 | Y4iQ/Y4nD/Y4sD (<30 aa-id.) |

TABLE 3-continued

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | hom. protein length (aa)[d] | hom. protein accession no.[e] | hom. protein I/ %[f] | hom. protein S/ %[f] | note[g] |
|---|---|---|---|---|---|---|---|---|---|---|---|
| y4pM | | +2 | 329159–329977 | 272 | | | | | | | hyp. 30.9 kd protein |
| fp5 | | – | 330657–331414 | | | | | | | | put. frameshift: 331032 (2<1) |
| y4pN | syrM1 | –3 | 332506–333522 | 338 | 13-324 | SyrM | 326 | M33495 | 63 | 77 | probable symbiotic regulator (LysR family) |
| | | | | | 1-338 | SyrM2 | 339 | thiswork | 62 | 79 | |
| y4pO | | +1 | 335062–336264 | 400 | 1-400 | Tnp | 400 | M60971 | 96 | 98 | prob. transposase (Mutater family); similarity to fe7 |
| fq2 | | –2 | 333987–335003 | 338 | 1-320 | OtsA | 474 | X69160 | 44 | 61 | join fq1 + fq2: hom. to trehalose-6-phosphate synthase interupted by ISRm3-like element NGRIS-8; similarity to Y4pC (45% aa-id.) |
| fq1 | | –1 | 336311–336694 | 128 | 44-174 | OtsA | 474 | X69160 | 48 | 67 | see fq2 |
| fq3 | | + | 337338–338056 | | | | | M26938 | | | virG homologous fragments: stop at 37380; put. frameshift at 337844 (3>2); similar to fn1 |
| y4qB | | –1 | 339053–339547 | 164 | | | | | | | hyp. 18.8 kd protein |
| y4qC | | –3 | 339535–341286 | 583 | 314–489 | ORF | 401 | Z54354 | 28 | 46 | hyp. 63.6 kd protein |
| | | | | | 1-583 | Y4oA | 593 | this work | 30 | 50 | |
| y4qD | | –3 | 343216–343950 | 244 | 1-244 | Y4oA | 618 | this work | 55 | 74 | hyp. 26.8 kd protein, similar to N-terminus cf Y4rO |
| y4qE | | +2 | 344114–345286 | 390 | 37-380 | Tnp | 364 | X77623 | 38 | 57 | prob. transposase; low similarity to Y4pF/Y4sB, Y4iB, Y4iO and Y4rJ (<30% aa-id.) |
| fq4 | | +3 | 345798–346130 | | | | | M38257 | 34 | 51 | fragments homologous to XerC (integrase) |
| y4qF | | –2 | 346215–348479 | 754 | 41-725 | PtrII | 707 | D10976 | 31 | 49 | prob. peptidase (S9A family); high similarity to Y4sO; |
| | | | | | 32-736 | Y4sO | 705 | this work | 70 | 84 | low similarity to Y4nA (<25% id.) |
| y4qG | | –2 | 348501–349847 | 448 | 40-389 | YgjG | 454 | U32722 | 42 | 62 | prob. aminotransferase (class 3) |
| y4qH | | –1 | 350294–351274 | 326 | 144-326 | LasR | 239 | M59425 | 37 | 51 | hyp. transcriptional regulator (LuxR family) |
| y4qI | | –2 | 351837–353456 | 539 | 146-419 | ORF1 | 322 | M25805 | 44 | 63 | hyp. 59.7 kd protein; similar to Y4aQ, Y4hP, Y4iD |
| fq5 | | –3 | 353533–353775 | | | | | | | | fragments fq5 and fr3 represent one put. gene similar to Y4hO and Y4jC interrupted by IS elements |
| y4qJ | | –1 | 354140–355336 | 398 | 7-395 | TnpA | 388 | U14952 | 42 | 60 | put. transposase |
| y4qK | | –2 | 355344–356270 | 308 | 51-293 | Int | 259 | U14952 | 39 | 55 | put. integrase/recombinase ("phage-type"); similar to |
| | | | | | 51-308 | Y4eF | 251 | this work | 92 | 94 | Y4rF; low similarity to Y4rABCDE |
| fq6 | | –2 | 356436–356636 | 66 | 1-66 | Fe5 | 66 | this work | 79 | 94 | put. defective integrase/recombinase ("phage-type"); 75% |
| | | | | | | Y4rC | 332 | this work | 45 | 62 | nt-identity: 356436–356710 and 94988–95262 R[20] |
| y4rA | | +1 | 356803–358032 | 409 | 17-397 | ORF2 | 415 | L34580 | 39 | 55 | put. integrase/recombinase ("phage-type") |
| y4rB | | +3 | 358029–358973 | 314 | 135-267 | TnpI | 284 | X07651 | 30 | 51 | put. integrase/recombinase ("phage-type") |
| y4rC | | +2 | 358970–359968 | 332 | 22-294 | XerC | 295 | U32696 | 31 | 50 | put. integrase/recombinase ("phage-type") |
| | | | | | 267-332 | Fe5 | 66 | this work | 41 | 55 | |
| | | | | | 267-332 | Fq6 | 66 | this work | 45 | 62 | |
| y4rD | | –3 | 360025–360870 | 281 | 15-277 | XprB | 298 | M54884 | 25 | 46 | put. integrase/recombinase ("phage-type") |
| y4rE | | –2 | 360867–361799 | 310 | 50-288 | YqkM | 296 | D84432 | 27 | 48 | put. integrase/recombinase ("phage-type"); low similarity to Y4gA |
| y4rF | | –1 | 361796–363073 | 425 | 126-414 | ORF2 | 415 | L34580 | 34 | 49 | put. integrase/recombinase ("phage-type") |
| y4rG | | –1 | 363287–363694 | 135 | 16-109 | ORF1 | 130 | U19148 | 32 | 48 | hyp. 14.8 kd protein (IS866 family); low similarity to Y4jB, Y4hN |
| y4rH | | –3 | 363895–365331 | 478 | 62-374 | Bcp | 598 | X63470 | 26 | 44 | put. ligase; hom. to biotin carboxylases |
| fr1 | | –3 | 366307–366669 | | | | | | | | 85% aa-identity to part of Y4rL |
| fr2 | | – | 366594–367402 | | | | | | | | put. frameshift: 367296 (–2<–1) |

TABLE 3-continued

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | hom. protein length (aa)[d] | hom. protein accession no.[e] | I/ %[f] | S/ %[f] | note[g] |
|---|---|---|---|---|---|---|---|---|---|---|---|
| fr3 | | −3 | 367705–367827 | | | | | | | | hom. to N-term. of Y4hO; see fq5 |
| y4rI | | −3 | 368503–369675 | 390 | | | | | | | hyp. 44 kd protein |
| y4rJ | | +1 | 369697–370887 | 396 | 152–379 | Tnp | 339 | M80806 | 28 | 45 | put. transposase; low similarity to Y4qE (<30% aa-id.) |
| | | | | | 135–244 | Y4iA | 120 | this work | 74 | 87 | |
| | | | | | 266–396 | Y4iB | 130 | this work | 76 | 84 | |
| | | | | | 135–396 | Y4iO | 252 | this work | 71 | 83 | |
| | | | | | 2-131 | Y4iP | 131 | this work | 58 | 80 | |
| y4rK | | −1 | 370976–371350 | 124 | | | | | | | hyp. 14.5 kd protein |
| y4rL | | −2 | 371454–371921 | 155 | 1-99 | Y4zA | 295 | this work | 99 | 99 | hyp. 17.7 kd protein; y4rLM: two fragments of one gene?; put. frameshift: 371972 (−2<−3); 85-99% aa-identity to parts of Y4ZA and fr1 |
| | | | | | 17-155 | Y4iE | 135 | this work | 33 | 52 | |
| y4rM | | −3 | 371938–372990 | 350 | 258-339 | Y4zA | 295 | this work | 98 | 98 | hyp. 39.4 kd protein; see y4rL |
| y4rN | | −2 | 373578–374795 | 405 | 35-368 | P43 | 416 | X57470 | 26 | 44 | hyp. 41.6 kd integral membrane protein |
| y4rO | | +1 | 375313–377169 | 618 | 274-596 | HIN0578 | 366 | U32742 | 25 | 45 | hyp. 69.3 kd protein; N-terminus: hom. to Y4qD; C-terminus: hom. to C-terminus of histidinol-1-phosphate transaminase |
| | | | | | 1-244! | Y4qD | 244 | this work | 55 | 74 | |
| fr4 | | + | 377185–377534 | | | | | X66016 | | | sim. to Y4rG; put. frameshift: 377376 (1>3); hom. to fragment of ORFA3 (377409–377540) |
| y4sA | | −3 | 377842–378249 | 135 | — | — | — | — | — | — | see y4pE |
| y4sB | | −1 | 378533–379696 | 387 | — | — | — | — | — | — | see y4pF |
| y4sC | | −2 | 379722–380300 | 192 | — | — | — | — | — | — | see y4pG |
| y4sD | | −1 | 380933–381829 | 298 | — | — | — | — | — | — | see y4iQ |
| y4sE | | −3 | 381826–383340 | 504 | — | — | — | — | — | — | see y4jA |
| fs5 | | −3 | 383593–384054 | 153 | 8-150 | Tnp | 334 | Z48244 | 48 | 65 | put. defective transposase; sim. to fs1 |
| | | | 384210–384493 | | | | | | | | fragments with 94–84% nt-id. to ISRm6 (*R. meliloti*; acc. no. X95567) |
| y4sG | | +1 | 384808–385818 | 336 | 97-325 | Dd1 | 306 | M14029 | 34 | 57 | hom. to D-alanine:D-alanine ligase; probably different function |
| y4sH | | +3 | 386505–387890 | 461 | 267-337 | CapA | 411 | M24150 | 42 | 63 | hom. to encapsulation protein A; nearly identical to Y4uA |
| fs1 | | − | 388138–388586 | | | Tnp | | Z48244 | | | fragments of put. transposase; put. frameshift: 388452 (−3<−2); sim. to Y4pF, Y4sB, fs5 |
| fs2 | | +2 | 388697–388897 | | | ORF1 | | U19148 | 43 | 62 | put. transposase fragment; hom. to N-term. of ORF1; sim. to Y4jB, Y4rG, Y4hN |
| fs3 | | + | 388966–390695 | | | AtoC | | U17902 | | | put. transcriptional regulator fragment (put. frameshifts: 389891 (1>2); 390170 (2>3)); sim. to Y4pA, Y4oV, Y4oT) |
| y4sI | | +2 | 390971–393241 | 756 | 325-741 | McpA | 657 | X66502 | 41 | 60 | prob. methyl-accepting chemotaxis protein |
| | | | | | 1-749 | Y4fA | 845 | this work | 29 | 49 | |
| y4sJ | gapD | −3 | 393202–394677 | 491 | 29-489 | GabD | 482 | M88334 | 58 | 75 | prob. succinate-semialdehyde dehydrogenase |
| y4sK | | −1 | 394790–395170 | 126 | 5-122 | C23G10.2 | 185 | U39851 | 55 | 71 | bel. to the YER057C/YIL051C/YJGF family; probably important cellular function |
| y4sL | | −1 | 395204–395815 | 203 | 2-203 | DadA | 432 | L02948 | 57 | 74 | either functional dehydrogenase or non-functional fragment; hom. to small subunit of D-aminoacid |

TABLE 3-continued

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | hom. protein length (aa)[d] | hom. protein accession no.[e] | I/ %[f] | S/ %[f] | note[g] |
|---|---|---|---|---|---|---|---|---|---|---|---|
| | | | | | | | | | | | dehydrogenase |
| y4sM | | +1 | 395935–396318 | 127 | 1-127 | ORF1 | 127 | X74314 | 99 | 99 | put. transcriptional regulator (AsnC/Lrp family; low homology to y4tD); missing H-T-H region |
| y4sN | | +1 | 396523–396900 | 125 | 1-123 | ORF2 | >123 | X74314 | 98 | 98 | similar to ORFs derived from insertion elements (IS6501 family); low similarity to fu4 |
| fs4 | | + | 396855–397283 | (143 | 8-141 | ORF1 | 186 | X53945 | 48 | 63 | put. IS-derived protein fragment (homology to C-term. of ORF1 from IS869) |
| | | | | | 1-141 | Fp2 | 145 | this work | 39 | 62 | |
| y4sO | | −2 | 397608–399725 | 705 | 10-694 | PtrII | 706 | D10976 | 32 | 49 | prob. peptidase (S9A family); low similarily to Y4nA (<25% id.) |
| | | | | | 1-705 | Y4qF | 754 | this work | 70 | 84 | |
| ft1 | | +3 | 400377–400625 | (83) | 20-83 | Y4tE | 300 | this work | 64 | 78 | ft1 and ft2: one put. gene encoding an amino acid ABC transponter binding protein interrupted by NGRIS-3c |
| y4tA | | −3 | 400732–401523 | 263 | — | — | — | — | — | — | see y4bM |
| y4tB | | −2 | 401520–403070 | 516 | — | — | — | — | — | — | see y4bL |
| ft2 | | +1 | 403249–403899 | (216) | 5-195 | ArgT | 260 | V01368 | 25 | 48 | see ft1 |
| | | | | | 2–215 | Y4tE | 300 | this work | 76 | 86 | |
| y4tD | | +1 | 404182–404691 | 169 | 11-161 | HIN1362 | 168 | U32817 | 38 | 64 | put. transcriptional regulator (AsnC/Lrp family; but low homology to y4sM) |
| y4tE | | +1 | 405157–406059 | 300 | 31-281 | FliY | 257 | U32734 | 27 | 48 | prob. aminoacid ABC transporter binding protein (periplasmic); prob. part of binding-protein-dep. transport system Y4tEFGH |
| | | | | | 86-299 | Ft2 | 215 | this work | 76 | 86 | |
| y4tF | | +1 | 406111–406827 | 238 | 25-233 | YckJ | 234 | X77636 | 35 | 54 | prob. aminoacid ABC transporter permease protein |
| Y4tG | | +3 | 406830–407525 | 231 | 1-220 | GlnP | 226 | D30762 | 32 | 54 | prob. aminoacid ABC transporter permease protein |
| y4tH | | +2 | 407522–408295 | 257 | 5-256 | GlnQ | 242 | M61017 | 52 | 71 | prob. amino acid ABC transporter ATP-binding protein |
| y4tI | | +1 | 408745–409953 | 402 | 22-391 | Slr0072 | 393 | D64004 | 35 | 54 | put. peptidase (M40 family) |
| y4tJ | | +1 | 409990–410988 | 332 | 7-328 | Thd2 | 329 | M21312 | 35 | 57 | put. threonine dehydratase |
| y4tK | | +3 | 410988–411983 | 331 | 69-326 | ArcB | 351 | U39262 | 30 | 44 | hyp. cyclodeaminase; (sim. to ornithine cyclodeaminase) |
| y4tL | | +2 | 412118–413290 | 390 | 10-384 | ORF | 411 | D14463 | 27 | 45 | hyp. hydrolase/peptidase (M24 family) |
| | | | | | 1-389 | Y4tM | 392 | this work | 34 | 53 | |
| y4tM | | +2 | 413453–414631 | 392 | 17-390 | PepQ | 368 | Z34896 | 24 | 43 | put. hydrolase/peptidase (M24 family) |
| | | | | | 1-390 | Y4tL | 390 | this work | 34 | 53 | |
| y4tN | | +1 | 414655–415179 | 174 | | | | | | | hyp. 19.6 kd protein |
| y4tO | | +1 | 415252–416847 | 531 | 1-484 | OppA | 543 | M60918 | 28 | 46 | prob. peptide ABC transporter binding protein precurser; prob. part of a binding-protein-dependent transport system Y4tOPQRS |
| y4tP | | +2 | 416852–417793 | 313 | 4-313 | DPPB | 339 | L08399 | 36 | 58 | prob. peptide ABC transporter permease protein |
| y4tQ | | +1 | 417796–418671 | 291 | 9-287 | AppC | 303 | U20909 | 36 | 56 | prob. peptide ABC transporter permease protein; 418611: C or T possible! |
| y4tR | | +2 | 418673–419680 | 335 | 12-327 | OppD | 336 | X56347 | 50 | 68 | prob. peptide ABC transporter ATP-binding protein |
| y4tS | | +1 | 419677–420738 | 353 | 3-320 | AppF | 329 | U20909 | 49 | 69 | prob. peptide ABC transporter ATP-binding protein |
| y4uA | | +3 | 420774–422159 | 461 | 267-337 | CapA | 411 | M24150 | 42 | 63 | put. cell wall compound biosynthesis protein; almost identical to Y4sH |
| y4uB | | +3 | 422628–424031 | 467 | 1-464 | BioA | 448 | U51868 | 33 | 57 | prob. aminotransferase (class 3) |
| y4uC | | +3 | 424056–425594 | 512 | 58-509 | GabD | 482 | M88334 | 33 | 52 | prob. aldehyde dehydrogenase |
| fu1 | | +2 | 425699–425779 | | | N15K | 238 | D45911 | | | put. protein fragment; 67% id. to N15K in 26 aa |

TABLE 3-continued

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | hom. protein length (aa)[d] | hom. protein accession no.[e] | I/ %[f] | S/ %[f] | note[g] |
|---|---|---|---|---|---|---|---|---|---|---|---|
| fu2 | | +3 | 425841–426083 | | | PhbA | 393 | U17226 | | | fragment 65% identical to C-term. of beta-keto-thiolase |
| y4uD | | +1 | 426010–426507 | 165 | | | | | | | hyp. 18.7 kd protein |
| y4uE | | −3 | 426949–428028 | 359 | 78-290 | Tnp | 414 | X15942 | 31 | 45 | put. transposase (IS110 family); put. frameshift: between 427040 and 427180 (−2<−3; end of shifted ORF: 426699) |
| y4uF | | +3 | 428292–429623 | 443 | 13-440 | GLUD1 | 558 | X07674 | 42 | 60 | prob. glutamate dehydrogenase |
| fu3 | | + | 429860–430007 | | | Tnp | 398 | U08627 | | | put. transposase fragment (92% id. in 16 aa); 85% nt-identity to 3'term. part of ISRm5 |
| y4uG | | +1 | 430105–430320 | 71 | | | | | | | hyp. 7.8 kd protein |
| y4uH | | −1 | 430538–431284 | 248 | 1-202 | ORF2 | 231 | X79443 | 48 | 63 | put insertion sequence ATP-binding protein; similarity to |
| | | | | | 1-245 | Y4pL | 245 | this work | 61 | 77 | Y4pL, Y4bM/Y4kI/Y4tA and Y4iQ/Y4nD/Y4sD |
| | | | | | 1-248 | Y4bM | 263 | this work | 48 | 68 | (IS21/IS1162 family) |
| | | | | | 4-248 | Y4iQ | 298 | this work | 31 | 52 | |
| y4uI | | −3 | 431296–432840 | 514 | 1-514 | Tnp | 518 | L09108 | 44 | 63 | put. transposase; similarity to Y4bL/Y4kJ/Y4tB (IS21/IS1162 family) |
| fu4 | | − | 433222–433560 | | | Tnp | 201 | X65471 | | | put. transposase fragments (74-92% id. in 88 aa); 79% nt-identity to 5'term. of ISRm4 |
| y4uJ | fixU | −1 | 433880–434110 | 76 | 1-70 | FixU | 70 | X51963 | 63 | 80 | hyp. 8.5 kd ptotein |
| y4uK | nifZ | −3 | 434107–434433 | 108 | 6-79 | ORF2 | >78 | X07567 | 52 | 78 | put. nitrogen fixation Nifz protein |
| y4uL | fdxN | −2 | 434517–434711 | 64 | 1-64 | FdxN | 64 | M21841 | 79 | 84 | prob. 4Fe-4S ferredoxin |
| y4uM | nifB | −1 | 434753–436234 | 493 | 1-493 | NifB | 490 | M15544 | 72 | 81 | involved in FeMo cofactor biosynthesis |
| y4uN | nifA | −1 | 436460–438244 | 594 | 37-594 | NifA | 584 | U31630 | 62 | 74 | positive regulator of nif, fix, and additional genes (sigm54-dep.) |
| 4yuO | fixX | −2 | 438297–438590 | 97 | 2-97 | FixX | 98 | M15546 | 84 | 89 | prob. 3Fe-35 ferredoxin inv. in nitrogen fixadon |
| y4uP | fixC | −1 | 438605–439912 | 435 | 1-435 | FixC | 435 | M15546 | 82 | 89 | required for nitrogenase activity |
| y4vA | fixB | −2 | 439923–441032 | 369 | 18–363 | FixB | 353 | M15546 | 79 | 87 | putatively inv. in a redox process in nitrogen fixation |
| y4vB | fixA | −2 | 441042–441899 | 285 | 1-280 | FixA | 292 | M15546 | 75 | 90 | putatively inv. in a redox process in nitrogen fixation |
| fv1 | | −1 | 442181–442252 | | | Nifs | 384 | X68444 | | | put. NifS fragment (70% idendtity in 24 aa) |
| y4vC | | −1 | 442316-442636 | 106 | 1-106 | ORF118 | 118 | X13691 | 54 | 72 | hyp. 11 kd protein (HesB/YadR/YfhF family); homologues located upstream of nifS |
| y4vD | | −2 | 443313–443879 | 188 | 5-173 | HIN1693 | 241 | U32848 | 46 | 60 | put. redox enzyme (hom. to glutaredoxin-like membrane protein and peroxysomat membrane proteins) |
| y4vE | nifQ | +1 | 444337–445029 | 230 | 56-212 | NifQ | 180 | M26323 | 39 | 56 | putatively involved in Mo cofactor processing |
| y4vF | dctA1 | +2 | 445088–446602 | 504 | 1-443 | DctA1 | 456 | S38912 | 99 | 99 | $C_4$-dicarboxylate transport protein; nt-deletion at 446416 in comparison to sequence of acc. no. S38912 causing a frameshift (DctA1 is 48 aa longer than DctA1 in S38912) |
| y4vG | | +1 | 446599–447843 | 414 | 1-3413 | CamC | 415 | M12546 | 34 | 50 | prob. cytochrome P450 |
| y4vH | | +1 | 447844–448500 | 218 | (32-157 | LinA | 155 | D90355 | 28 | 46) | hyp. 24.6 kd protein (with very weak homology to gamma-hexachlorocyclohexane-dechlorinase) |
| y4vI | | +3 | 448557–450203 | 548 | 9–250 | FabG | 244 | U39441 | 38 | 56 | short-chain type dehydrogenase/reductase |
| | | | | | 276-513 | | | | 30 | 48 | |
| y4vJ | | +2 | 450341–451396 | 351 | 1-188 | LuxA | 357 | M36597 | 27 | 47 | put. monooxygenase; similar to Y4wF; |
| y4vK | nifH1 | +1 | 451993-452883 | 296 | 1-296 | NifH | 296 | M26961 | 99 | 99 | Fe protein of nitrogenase |
| y4vL | nifD1 | +1 | 452980–454494 | 504 | 199-393 | NifD | >195 | M26962 | 98 | 99 | alpha-subunit of MoFe protein of nitrogenase |
| y4vM | nifK1 | +3 | 454590–456131 | 513 | 132-195 | NifK | >64 | M26963 | 100 | 100 | beta-subunit of MoFe protein of nitrogenase |

TABLE 3-continued

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | hom. protein length (aa)[d] | hom. protein accession no.[e] | I/%[f] | S/%[f] | note[g] |
|---|---|---|---|---|---|---|---|---|---|---|---|
| y4vN | nifE | +1 | 456187–457677 | 496 | 1-469 | NifE | 547 | X56894 | 62 | 78 | involved in FeMo cofactor biosynthesis |
| y4vO | nifN | +1 | 457687–459096 | 469 | 1-455 | NifN | 441 | M18272 | 70 | 81 | involved in FeMo cofactor biosynthesis |
| y4vP | nifX | +3 | 459093–459575 | 160 | 22-156 | NifX | 159 | X17433 | 52 | 68 | nitrogen fixation protein |
| y4vQ | | +3 | 459579–460067 | 162 | 22-162 | ORF4 | 156 | X17433 | 49 | 70 | hyp. 17.7 kd protein, similar to proteins of other |
| | | | | | 1-162 | Y4xD | 162 | this work | 61 | 75 | nitrogen-fixing bacteria and to Y4XD |
| y4vR | | +1 | 460501–460920 | 139 | 1-58 | NifH | 296 | M26961 | 50 | 63 | similar to N-term. of Fe protein of nitrogenase |
| y4vS | fdxB | +2 | 461228–461545 | 105 | 1-88 | ORF5 | 102 | M26323 | 52 | 65 | prob. 4Fe-4S ferredoxin |
| y4wA | | +1 | 463201–464739 | 512 | 86-499 | PqqE | 709 | LA3135 | 50 | 70 | hyp. zinc protease M16 family); sim. to Y4wB |
| y4wB | | +3 | 464736–466079 | 447 | 236-438 | PqqF | 213 | LA3135 | 42 | 61 | put. protease (lacks Zn-binding site; M16 family); sim. to Y4wA |
| y4wC | | +3 | 466590–467021 | 143 | 8-132 | ORF3 | 127 | L13845 | 48 | 66 | put. DNA-binding protein; high similarity to Y4aM |
| | | | | | 1-143 | Y4aM | 143 | this work | 69 | 77 | |
| y4wD | | +1 | 467758–468891 | 377 | 11-370 | MosC | 407 | U23753 | 29 | 48 | permeasc-type protein; hom. to membrane protein from the rhizopine biosynthesis (mosABC) gene cluster |
| y4wE | | +3 | 469311–470417 | 368 | 20-361 | His1 | 356 | D14440 | 32 | 53 | prob. aminotransferase (class 2) |
| y4wF | | +1 | 470824–471852 | 342 | 40-194 | LuxA | 354 | X06758 | 27 | 54 | put. monooxygenase; sim. to Y4vJ |
| y4wG | | +2 | 471890–472435 | 181 | | | | | | | hyp. 19.4 kd protein |
| y4wH | | +3 | 473343–473780 | 145 | 1-145 | ORF2 | 145 | M19352 | 64 | 76 | hyp. 15.6 kd protein |
| y4wI | | −2 | 473928–475469 | 513 | | | | | | | hyp. 59 kd protein |
| y4wJ | | −2 | 475503–475880 | 125 | | | | | | | hyp. 13.3 kd protein |
| y4wK | nifW | −1 | 476519–476971 | 150 | 12-118 | NifW | 108 | M86823 | 50 | 63 | NifW protein homolog; required for full activity of FeMo protein |
| y4wL | nifS | −2 | 477135–478298 | 387 | 4–387 | NifS | 402 | M17349 | 58 | 73 | prob. NifS protein (member of class-5 pyridoxal-phosphate-dep. aminotransferase family) |
| y4wM | | −2 | 479145–481136 | 663 | 225-620 | YejA | >409 | U00008 | 38 | 55 | put. ABC transporter binding protein (transporter or enzymatic function) |
| fw1 | | −1 | 481460–481834 | 124 | 1-116 | DctA | 441 | M26531 | 55 | 61 | hyp. truncated transporter-like protein; hom. to N-term. of DctA (see y4vF); two frameshifts acc. to homologue: 481606 (−3<−1); 481530 (−2<−3; homology stops at 481419) |
| y4wO | | −3 | 481834–482154 | 106 | | | | | | | hyp. 11 kd protein |
| y4wP | | +2 | 482540–482947 | 135 | | | | | | | hyp. 14.9 kd protein |
| y4xA | nifH2 | +1 | 483871–484761 | 296 | 1-296 | NifH | 296 | M26961 | 99 | 99 | Fe protein of nitrogenase |
| y4xB | nafD2 | +1 | 484858–486372 | 504 | 199–393 | NifD | >195 | M26962 | 98 | 99 | alpha-subunit of MoFe protein of nitrogenase |
| y4xC | nifK2 | +3 | 486468–488009 | 513 | 132-195 | NifK | >64 | M26963 | 100 | 100 | beta-subunit of MoFe protein of nitrogenase |
| y4xD | | +3 | 488262–488750 | 162 | 22-162 | ORF4 | 156 | X17433 | 47 | 73 | hyp. 18 kd protein; similar to proteins of other nitrogen- |
| | | | | | 2-162 | Y4vQ | 162 | this work | 61 | 75 | fixing bacteria and to Y4vQ |
| y4xE | | +1 | 488773–488976 | 67 | 1-64 | ORF1 | 69 | X55450 | 40 | 67 | hyp. 7.6 kd protein; similar to proteins of other nitrogen-fixing bacteria |
| y4xF | | +3 | 488973–489149 | 58 | | | | | | | hyp. 6.5 kd protein |
| y4xQ | | +2 | 489281–489583 | 100 | 14-83 | ExoX | 98 | M61751 | 31 | 52 | put. exopolysaccharide production repressor (integral membrane protein) |
| y4xG | | +2 | 490010–491527 | 505 | | | | | | | hyp. 55.5 kd protein |
| y4xH | nodD2 | −2 | 491655–492593 | 312 | 1-312 | NodD2 | 312 | L38460 | 99 | 99 | transcriptional regulator (LysR family); high similarity to |

TABLE 3-continued

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | hom. protein length (aa)[d] | hom. protein accession no.[e] | I/ %[f] | S/ %[f] | note[g] |
|---|---|---|---|---|---|---|---|---|---|---|---|
| | | | | | 1-310 | NodD1 | 322 | this work | 68 | 83 | Y4aL, (NodD1) |
| y4xI | | +2 | 494297–494977 | 226 | 1-224 | PmrA | 222 | L13395 | 39 | 58 | signal transduction-type regulator |
| y4xJ | | +1 | 495157–496428 | 423 | 76-378 | GPIV | 426 | J02451 | 27 | 46 | hyp. protein hom. to proteins of the general secretion pathway (pulD family), sim. to Y4yD (NolW) |
| y4xK | | +1 | 496438–497004 | 188 | | | | | | | hyp. 20.6 kd protein precurser |
| y4xL | | −1 | 497444–498460 | 338 | | | | | | | hyp. 37.1 kd protein |
| y4xM | | −1 | 498719–499933 | 404 | 23-403 | ORF1 (YceE) | 408 | X59939 | 22 | 49 | permease-type protein |
| y4xN | | −3 | 499930–501816 | 628 | 183-505 | IucC | 580 | X76100 | 28 | 43 | hyp. 71 kd protein hom. to aerobactin synthetase subunit |
| y4xO | | −2 | 501816–502955 | 379 | | | | | | | hyp. 40.9 kd protein |
| y4xP | | −1 | 502952–503962 | 336 | 5-304 | CysK | 308 | D26185 | 40 | 60 | put. cysteine synthase |
| y4yA | | −1 | 503963–505336 | 457 | | | | | | | hyp. 49.9 kd protein; low similarity to diaminopimelate decrboxylase |
| y4yB | | −3 | 505336–505800 | 154 | | | | | | | hyp. 17.1 kd protein |
| y4yC | nolX | −2 | 505950–507740 | 596 | 1-596 | NolX | 596 | L12251 | 98 | 99 | nodulation protein as in *R. fredii USDA257* |
| y4yD | nolW | −3 | 508021–508725 | 234 | 1-234 | NolW | 234 | L12251 | 99 | 100 | nodulation protein (PulD family); sim. to Y4xJ |
| y4yE | nolB | +3 | 508881–509375 | 164 | 1-164 | NolB | 164 | L12251 | 98 | 99 | nodulation protein |
| y4yF | nolT | +3 | 509385–510254 | 289 | 1-289 | NolT | 289 | L12251 | 96 | 97 | nodulation protein precurser (YscJ homolog; M74011) |
| y4yG | nolU | +2 | 510251–510889 | 212 | 1-212 | NolU | 212 | L12251 | 99 | 99 | nodulation protein |
| y4yH | nolV | +3 | 510891–511517 | 208 | 1-60 | ORF4 | 65 | L12251 | 100 | 100 | homologous to two (nodulation) proteins of *R.fredil* |
| | | | | | 73-208 | NolV | 135 | | 96 | 97 | USDA257 (YscL homolog; M74011) |
| y4yI | hrcN | +2 | 511514–512869 | 451 | 35-450 | YscN | 439 | U00998 | 55 | 73 | prob. ATPase involved in secretion |
| | | | | | 1-80 | HrcN | 450 | L12251 | 97 | 97 | |
| | | | | | 105-450 | | | | 97 | 98 | |
| y4yJ | | +1 | 512845–513381 | 178 | 1-178 | ORF7 | 178 | L12251 | 97 | 98 | hyp. 20.4 kd protein |
| v4yK | hrcQ | +1 | 513406–514482 | 358 | 171-350 | YscQ | 307 | L25667 | 27 | 46 | prob. translocation protein inv. in secretion processes |
| | | | | | 1-358 | HrcQ | 382 | L12251 | 96 | 98 | (FliN/MopA/SpaO family) |
| y4yL | hrcR | +2 | 514475–515143 | 222 | 6-216 | YscR | 217 | L25667 | 46 | 66 | prob. translocation protein inv. in secretion processes |
| | | | | | 1-222 | HrcR | 249 | L12251 | 99 | 99 | (FliP/MopC/SpaP family) |
| y4yM | hrcS | +1 | 515143–515418 | 91 | 1-66 | YscS | 88 | L25667 | 34 | 65 | prob. translocation protein inv. in secretion processes |
| | | | | | 1-91 | HrcS | 92 | L12251 | 98 | 100 | (FliQ/MopD/SpaQ family) |
| y4yN | hrcT | +3 | 515427–516245 | 272 | 28-250 | YscT | 261 | L25667 | 31 | 52 | prob. translocation protein inv. in secretion processes |
| | | | | | 1-272 | HrcT | 272 | L12251 | 98 | 99 | (FliR/MopE/SpaR family) |
| y4yO | hrcU | +2 | 516242–517279 | 345 | 5-339 | YscU | 354 | L25667 | 30 | 50 | prob. translocation protein inv. in secretion processes |
| | | | | | 1-340 | HrcU | 351 | L12251 | 99 | 99 | (FlhB/HrpN/YscU/SpaS family) |
| y4yP | | +1 | 518077–518892 | 271 | 35-262 | HipA | 295 | M19019 | 88 | 91 | homolog is inducible by root-exudate and diadzein; frameshift acc. to homologue: 518855 (1>2) |
| fy1 | | + | 519655–519995 | | | NolJ | 148 | L26967 | | | nodulation gene homologous fragments (80–100% id. in 97 aa); frameshifts acc. to homologue: 519789 (1>3); 519900 (3>2); 519965 (2>3) |
| y4yQ | | +2 | 520280–521170 | 296 | | | | | | | hyp. 31.3 kd integral membrane protein |
| y4yR | | +2 | 521360–523453 | 697 | 17-677 | LcrD | 704 | M96850 | 40 | 65 | prob. translocation protein inv. secretion processes [Flage11a/HR/Invasion proteins export pore (FHIPEP) family] |

TABLE 3-continued

List of the predicted functional ORFs and of fragments representing putative remnants of functionial ORFs

| ORF[a] | functional name | st.[b] | position in plasmid (base no.)[c] | no. of deduced amino acids | hom. amino acids (position) | hom. protein name | hom. protein length (aa)[d] | hom. protein accession no.[e] | I/ %[f] | S/ %[f] | note[g] |
|---|---|---|---|---|---|---|---|---|---|---|---|
| y4yS | | +3 | 523470–524018 | 182 | | | | | | | hyp. 20.1 kd protein |
| y4zA | | +2 | 525005–525892 | 295 | 34-115 | Y4rM | 350 | this work | 98 | 98 | hyp. (fragmentous?) 32.9 kd protein; put. frameshift: 525699 (2>3); similar to Y4iE |
| | | | | | 133-231 | Y4rL | 155 | this work | 99 | 99 | |
| y4zB | | +1 | 526051–527121 | 356 | 60-320 | Tnp | 377 | X67862 | 29 | 47 | put. (fragmentous?) transposase (IS4 family) 526103–526200 higher cod. prob. in fr. 2; put. frameshift: 526200 (2>1) |
| fz1 | | + | 527337–527902 | | | Hdc | 378 | J02577 | | | fragments homologous to histidine decarboxylases (30–45% id. in 134aa); put. frameshift (3>2) around 527478 |
| y4zC | | +3 | 529125–529910 | 261 | 65-248 | AvrPph3 | 276 | M86401 | 27 | 41 | hyp. 28.3 kd protein; hom. to avirulence protein |
| y4zD | | +3 | 530145–530294 | 49 | | | | | | | hyp. 5.5 kd protein |
| fz4 | | +2 | 530432–530764 | 110 | 1-110 | Y4jA | 504 | this work | 72 | 85 | hom. to C-terminus of Y4jA/Y4nE/Y4sE |
| fz2 | | + | 530761–531250 | | | ORFB | 251 | X67861 | | | put. IS-ATF-binding protein fragments (32–40% id. in 137aa); put. frameshift acc. to homolog: 531062 (1>2) |
| y4zF | syrM2 | +2 | 532676–533695 | 339 | 1–320 | SyrM | 326 | M33495 | 69 | 81 | prob. symbiotic regulator (LysR family) |
| | | | | | 1–335 | SyrMl | 338 | this work | 62 | 79 | |
| fz3 | | + | 534257–534422 | | | ORF | 338 | M73488 | | | fragments homologous to 1-aminocydopropane-1-cabboxylate deaminase (63–83% id. in 56aa); put. frameshift: 534291 |

[a]open reading frame (ORF)
[b]strand (–/+) or frame (–1; –2; –3; +1; +2; +3)
[c]number (no.)
[d]aminoacids (aa)
[e]GenBank/EMBL accession numbers
[f]identity (I)and similarity (S) have been calculated by the programme BESTFIT (local homology algorithm; Smith and Waterman, 1981) of the WISCONSIN SEQUENCE ANALYSIS PACKAGE (version 8.0, GCG, Madison, USA)
[g]abbreviations: prob. = probable; cod. prob. = coding probability; acc. = according; inv. = involved; sim. = similar; id. = identical; fr. = frame; acc. no. = accession number; nt = nucleotide; hyp. = hypothetical; put. = putative; hom. = homologous; dep. = dependent; N/C-term = N/C-terminus In a second stage, the remaining 436 kb of pNGR234a were analyzed. Several ORFs and their deduced proteins were identified that belong to functional groups not previously identified in the analysis of cosmids pXB296, pXB368 and pXB110 (replication of the plasmid, conjugal transfer of the plasmid, functions in oligosaccharide biosynthesis and cleavage, functions in sugar or sugar-derivative metabolism, functions in lipid or lipid-derivative metabolism, functions in chemoperception/chemotaxis, functions in biosynthesis of cofactors, prosthetic groups and carriers, etc.).

Although further functional analyses of selected ORFs in pNGR234a still have to be performed, large-scale sequencing gives a global picture of their genomic organization and possible roles. Determination of putative functions of predicted genes by homology searches and identification of sequence motifs (promoters, nod boxes, nifA activator sequences, and other regulatory elements) will aid in finding new symbiotic genes. High-fidelity sequence data covering long stretches of the genome are a prerequisite for these studies. The use of the dye terminator/thermostable sequenase shotgun approach has allowed the completion of the entire ~500 kb sequence of pNGR234a and has opened up new avenues for the genetic analysis of symbiotic function.

Genetic Organization of the Whole Plasmid pNGR234a

Within the complete nucleotide sequence of pNGR234a, which comprises 536,165 bp, a total of 416 ORFs were predicted to encode proteins. An additional 67 ORF-fragments were detected that seem to be remnants of functional ORFs.

Thirty four percent (139) of the 416 potential proteins, have no obvious similarities to any known proteins. Of the remaining 277 proteins, 31 (8%) are similar to proteins for which no biochemical or phenotypic role has been assigned, 12 (3%) are similar to proteins for which limited biological data is available, and 234 (56%) are similar to proteins with a more precise biological function: enzymes (95), proteins involved in integration and recombination of insertion elements (44), transporters (32), transcriptional regulators (22), protein secretion/export (21), proteins involved in replication and control of the plasmid (12), electron transporters (6), and proteins involved in chemotaxis (2). A high proportion of enzymes was expected of a symbiotic replicon involved in nodulation (Nod-factor biosynthesis, etc.) and nitrogen fixation. As expected from the observation that NGR234 can be cured of its plasmid (Morrison et al., 1983), no ORFs essential to transcription, translation or to primary metabolism were found.

A large number of protein families are present in several copies on pNGR234a. This is true even after elimination of the many proteins which are encoded in repeated IS elements, or are involved in transposition, integration or recombination. The most notable examples of highly represented protein families include: five members of the short-chain dehydrogenase/reductase family, one of which (y4vI) contains two homologous domains; Five complete and one partial ABC-type transporter operons that each encode for at least one ABC-type permease and an ABC-type ATP-binding protein; four cytochrome P450's; and three members of peptidase family S9A. In total, 85 proteins belong to families that are represented more than once and which do not seem to be linked to insertion or recombination.

The majority (330, 79%) of the putative proteins are probably located in the cytoplasm of the bacterium, 62 (15%) possibly span membranes, 20 (5%) could be located in the periplasm, 3 are predicted to be lipoproteins that could associate with the outer membrane, and 2 are probably outer membrane proteins. These observations accord well with the dominance of biosynthetic proteins, as well as proteins involved in transcriptional regulation and insertion/recombination, most of which are thought to be cytoplasmic.

Although other start points cannot be excluded, replication of pNGR234a probably begins at oriV which is located within the intergenic sequence (igs) between the repC and repB-like genes y4cI and y4cJ. This locus (positions 54,417 to 54,570) encodes three proteins with 40–60% amino acid identities to RepABC of pTiB6S3 (a Ti-plasmid of *Agrobacterium tumefaciens*), pRiA4b (an Ri-plasmid of *A. rhizogenes*) and pRL8JI (a cryptic plasmid of *R. leguminosarum* bv. *leguminosarum*). Amongst replication regions, highest identities (69 to 71% at the nucleotide level) are found in the igs's between repC and repB (FIG. 5). In Agrobacterium, these igs's are the determinants which render parental plasmids incompatible. Two ORF's (position 198,500), which are homologous to pseudomonal genes involved in plasmid stability, may also play a role in replication of pNGR234a. A 12 bp portion of the origin of transfer (oriT) is identical to that of pTiC58 of *Agrobacterium tumefaciens* (nt 80,162 to 80,173), and highly similar to those of RSF1010 (*Escherichia coli*) and pTFI (*Thiobacillus ferrooxidans*). This sequence corresponds to the oriT of plasmids containing the "Q-type nick-region" (FIG. 6).

Another 24 predicted ORFs show homologies to conjugal transfer genes of Agrobacterium Ti-plasmids. All are located in two large clusters between position 57,000 to 83,000. Since pNGR234a was believed to be non-transmissible (Broughton et al., 1987), the fact that both the nucleotide sequence of the individual ORFs and their order is similar in Agrobacterium and NGR234 came as a surprise. Conjugal transfer of Ti plasmids in *A. tumefaciens* is controlled by a family of N-acyl-L-homoserine lactone auto-inducers (Zhang et al., 1993). Similar molecules, which are able to interact with the traR gene product of *A. tumefaciens,* were detected in the supernatants of NGR234 cultures using the assay of Piper et al. (1993).

Reiterated sequences first became apparent in NGR234 during the construction of an ordered array of cosmid clones (Perret et al., 1991). It is now clear that 97 kbp (18%) of pNGR234a represents insertion-(IS) and mosaic-(MS) sequences (FIG. 7). Homology searches for known IS/MS revealed some of these, while comparison of repeated sequences within pNGR234a, as well as between the plasmid and 2,500 random chromosome sequences (V. Viprey, pers. communication) located the rest. Seventy five putative ORFs (18% of the total) and 40 fragments of ORFs were identified this way, nearly half of which (44) show homologies to integrases and transposases. Many of these IS elements are similar not only to those derived from Rhizobium and Agrobacterium species, but also to those of other, diverse Gram (−) and Gram (+) bacteria (e.g. Bacillus, Escherichia, and Pseudomonas). The shear number and diversity of these IS/MS elements suggests that NGR234 has functioned as a "transposon trap". This is supported by the fact that their average G,C content (61.5%) is 3% higher than that of pNGR234a (58.5%). Interestingly, many IS/MS are clustered between positions 300,000 to 390,000 (FIG. 7), while some loci are almost unaffected by insertions (oriV, nod-, fix- and nif-ORFs). Small IS/MS clusters divide the replicon into large blocks of often functionally related ORFs (e.g. blocks of nod-ORFs replication and conjugal transfer ORFs, nif-ORFs and fix-ORFs). A list of all sequences with IS-elment or mosaic sequence character is given in Table 4. Although transposition of these IS/MS elements has not been demonstrated, transfer of plasmids amongst rhizobia in the legume rhizosphere (Broughton et al., 1987) and to other non-symbiotic bacteria in fields (Sullivan et al., 1995) suggests that lateral transfer of genetic information has helped shape symbiotic potential.

TABLE 4

Insertion/mosaic sequences in pNGR234a

| start of region | stop of region | name of region | put. ORFs/ ORF-fragments included | similarities within pNGR234a | similarities to chromosome | homologous sequences in other organisms/comments |
|---|---|---|---|---|---|---|
| 17000 | 17600 | ISH-10b | y4aQ | 33% aa-id. to y4hP (ISH-10a) | | geneproducts from IS866 and IS66 from *Ag. tumefaciens* |
| 18900 | 19661 | ISH-11b | fa2 | 54% aa-id. to part of y4bF (ISH-11a); 19096–19362: 91% nt-id. to ISH-11c | | Tnp of IS1202 from *Str. pneumoniae* |
| 19666 | 22981 | NGRIS-4a | y4bABCD | identical to NGRIS-4b | many copies on the chromosome | |
| 22985 | 25400 | ISH-11a | fb1, y4bF | y4bF: sim. to fb1 and fa2 (ISH-11b) | partially 91% nt-id. to chromosomal sequences | Tnp of IS1202 from *Str. pneumoniae* |
| 32463 | 35085 | NGRIS-3a | y4bLM | identical to NGRIS-3b/c | copie(s) on the chromosome | 62% nt-id. (over 2352 nt) to IS1162 of *Ps. fluorescens* (IS21/IS1162/IS408 family) |
| 49300 | 50300 | ISH-13a | y4cG | similar to y4lS (ISH-13b) | | DNA invertase |
| 69936 | 70385 | ISH-4c | fd1 | 70233–70385: 93% nt-id. to part of NGRIS-4 | | ORFA of IS5376 from *B. stearothermophilus* |
| 93322 | 96025 | ISH-12a | fe2, y4eF, fe5, fe3 | 93574–94927: 90% nt-id. to ISH-12b1; 75% nt-id. to fq6 region (ISH-12b2); 95343–95558: 88% nt-id. to ISH-12b3 | | Tnp (fe2) and Int (4AeF, fe3) from *Weeksella zoohelcum* -IS-element; (93322–94586: 57% nt-id. to IS292 from *Ag. radiobacter*); “phage” Integrase family (Y4eF, fe5, fe3) |
| 101939 | 102394 | ISH-8b | fe7 | | | 84% nt-id. to ISRm5 of *R. meliloti*; fe7: mutator family of transposases |
| 115881 | 116004 | MSH-14b | | partially homologous to ISH-14a | 72–73% nt-id. to sequences downstream from chvl/up-stream from rpoN on the chromosome | mosaic element |
| 124396 | 124500 | MSH-14a | | partially homologous to ISH-14b | 82% nt-id. to sequence RIME1 downstream from chvl on the chromosome; parts of MSH-14a show 73–89% nt-id. to chromo-somal sequences | mosaic element |
| 126806 | 127369 | ISH-12f | y4gA | low. similarity to y4rE | | |
| 127900 | 128500 | ISH-12e | y4gC | | | recombinase from pAE1 of *Al. eutrophus* (“phage” integrase family) |
| 131000 | 131800 | ISH-15 | y4gE* | | partially 87% nt-id. to chromosomal sequences | |
| 159781 | 160564 | ISH-16 | | | | 96% nt-id. to repetitive sequence from *R. fredii* USDA257 (acc. no. M73698) |
| 164600 | 167700 | ISH-10a | y4hNOPQ | | 99% nt-id. of parts of y4hPQ to chromosomal sequences | different ORFs derived from IS-like sequences; partially known as acc. no. X74068 (“Region2” from pNGR234a); 164853–167086: 66% nt-id. to IS66 from *Ag. tumefaciens* |
| 168208 | 169190 | ISH-2c | fi1, fi2, fi3 | 168343–168659: 72% nt-id. to ISH-2f1/ ISH-2d1 165785–169091: 73% nt-id. to ISH-2f2/ ISH-2d2 | | 168208–168383: 70 nt-id. to ISRm2011–2 (*R. meliloti*); fi2/3: IS1111A, IS1328, IS1533 family of transposases |
| 173295 | 173702 | ISH-8g | y4iE* | y4iE: sim. to y4rL, y4zA, and fr2 | | |
| 175590 | 175909 | ISH-11c | y4iG* | 175643–175909: 91% nt-id. to ISH-11a | | |
| 185672 | 186507 | ISH-2d | y4iO*/P* (3'-end) | 185672–186075(−): 73% nt-id. to ISH-2c2(+) 186208–186507(−): 72% nt-id. to ISH-2c1(+) | | Y4iO: Tnp of IS1325 from *Y. enterocolitica* (IS1111A, IS1328, IS1533 family) |
| 187112 | 189752 | NGRIS-5a | y4iQjA | identical to NGRIS-5b/c | copie(s) on the chromosome | 1stA and B (Tnps) of IS1326 from *E. coli* (IS21/IS1162/IS408 family) |
| 190000 | 193500 | ISH-10c | y4jBCD(E*) | 38/32 aa-id. of y4jCD to y4hOP (ISH10a) | | different ORFs derived from IS-like sequences; partially 60% nt-id. to IS866 (*Ag. tumefaciens*); IS292 (*Ag. radiobacter*); ISR11 (*R. leguminosarum*) |
| 193518 | 193634 | MSH-17 | | | | 76% nt-id. to repetitive sequence RMX6 from *Myxococcus xanthus* (acc. no. M60865) |
| 199746 | 199958 | ISH-11d | y4jM* | similarity to fb1 and y4bF (ISH-11a) | | |
| 211165 | 211265 | ISH-10g | | | | 74% nt-id. to ISR11 (*R. leguminosarum*), IS66/IS866 derivative |
| 211350 | 212580 | ISH-10h | fk2 | similar to y4jD (ISH-10c) | | 74% nt-id. to IS66 |
| 217564 | 220186 | NGRIS-3b | y4kIJ | identical to NGRIS-3a/c | copie(s) on the | 62% nt-id. (over 2352 nt) to IS1162 of |

TABLE 4-continued

Insertion/mosaic sequences in pNGR234a

| start of region | stop of region | name of region | put. ORFs/ ORF-fragments included | similarities within pNGR234a | similarities to chromosome | homologous sequences in other organisms/comments |
|---|---|---|---|---|---|---|
| | | | | | chromosome | *Ps. fluorescens* (IS21/IS1162/IS408 family) |
| 224547 | 224995 | ISH-18a | y4kQ (3'-end) | 83% nt-id. to ISH18b (427651–428102) | | IS110 family |
| 240800 | 241040 | ISH-24b | fl2 | | | 60% nt-id. to ISR12 from *R. leguminosarum* |
| 244540 | 244851 | ISH-19a | fl4 | 244620–244812: 97% nt-id. to ISH-19b | | TnpA from Tn163 (*R. leguminosarum*) |
| 248290 | 248655 | ISH-19b | fl5 | 248463–248655: 97% nt-id. to ISH-19a | | |
| 248814 | 249680 | ISH-20 | fl6 | | | Tnp of Tn1546 (*Enterococcus faecium;* Tn21/501/1721 family) |
| 251407 | 252400 | ISH-13b | y4lSmA | y4lS: similar to y4cG (ISH-13a) | | y4lS: invertase; 58% nt-id. (251409–252211) to Tn501 from *Ps. aeruginosa* (acc. no. Z00027) |
| 258551 | 258657 | MSH-21 | | | | mosaic sequence: 82% nt-id. to sequence up-stream of ropA2 (*R. leguminosarum*; acc. no. X80794) |
| 280403 | 283043 | NGRIS-5b | y4nDE | identical to NGRIS-5b/c | copie(s) on the chromosome | 1stA and B (Tnps) of IS1326 from *E. coli* (IS21/IS1162/IS408 family) |
| 284722 | 284985 | ISH-1b | fn2 | | | 60% nt-id. to IS1162 (*Ps. fluorescens,* IS21/IS1162/IS408 family) |
| 300017 | 300819 | ISH-1c | fo3 | | | 61% nt-id. IS408 (*Ps. cepacia;* IS21/IS1162/IS408 family) |
| 300820 | 304117 | NGRIS-6 | fo4/5/6, y4oL/M/N | 77% nt-id. to NGRIS-4 | | |
| 304118 | 304434 | ISH-1d | fo7 | | | 61% nt-id. IS408 (*Ps. cepacia;* IS21/IS1162/IS408 family) |
| 318854 | 319686 | NGRIS-7 | fp1-2 | | | 66% nt-id. to IS1248 of *Pa. denitirificans* |
| 320456 | 328935 | NGRRS-1a | fp3/4; y4pL | | 3 copies on the chromosome | interrupted by NGRIS2a and 4b; fp3/4, Y4pL: IS21/IS1162/IS408 family |
| 320590 | 323147 | NGRIS-2a | y4pEFG | identical to NGRIS-2b | | partially 88–90% nt-id. to repetitive sequence RDRS9 of *R. fredii* USDA257 (IS1111A/ IS1328/IS1533 family) |
| 323961 | 327276 | NGRIS-4b | y4pHIJK | identical to NGRIS-4a | many copies on the chromosome (disrupts all 4 copies of NGRRS-1) | |
| 335004 | 336301 | NGRIS-8 | y4pO | similar to fe7 (ISH-8b) | | 88% nt-id. to ISRm3 of *R. meliloti*: mutator family of transposases |
| 342272 | 342419 | ISH-12d | | 342272–342419: 87% nt-id. to ISH-12b4 | | |
| 344100 | 345300 | ISH-2e | y4qE | | | Tnp (*Leptospira borgpetersenii*): IS1111A/IS1328/IS1533 family |
| 345755 | 346133 | ISH-12c | fq4 | 345755–346133: 82% nt-id. to ISH-12b5 | | Int (XerC, *E. coli*): "phage" integrase family |
| 351600 | 351735 | MSH-22 | | | | 80 nt-id. to sequence from pTiS4 (*Ag. vitis*; acc. no. M91609) |
| 351826 | 353794 | ISH-10d | y4qI, fq5 | fq5: 35% aa-id. to y4hQ (ISH-10a) | 71–95% nt-id. of parts of y4qI to chromosomal sequences | 67% nt-id. to ISR11 (*R. leguminosarum*; acc. no. L19650); IS866/66 homolog |
| 354000 | 363073 | ISH-12b | y4qJK, fq6, y4rABCDEF | 354942–35612/356215–356383: 90/91% nt-id. to ISH12a1; 75% nt-id. to fe5 region (ISH-12a2); 359753–359968: 88% nt-id. to ISH-12a3; 361029–361410: 82% nt-id. to ISH-12c 362507–362654: 87% nt-id. to ISH-12d | 70% nt-id. of parts of ISH14a1 to chromosomal sequences | Tnp and Int from *Weeksella zoohelcum* -IS-element (y4qJK), different intergrases (y4rAB), integrase XerC of *H. influenzae* (y4rC); y4qK, fq6, y4rABCDEF: "phage" integrase family |
| 363287 | 363694 | ISH-10i | y4rG | low similarity to y4jB and fr4 (ISH-10c/i) | | unknown protein from IS1312 (*Ag. tumefaciens*)/IS866 |
| 366252 | 367402 | ISH-8f | fr1, fr2 | 366252–366524: 88% nt-id. to ISH-8e 366773–366953: 92% nt-id. to ISH-8g | | |
| 367699 | 367970 | ISH-10e | fr3 | 56% aa-id. of fr3 to y4hO (ISH-10a) | | 75% nt-id. to IS66 (*Ag. tumefaciens*) |
| 368503 | 369675 | ISH-23 | y4rI | | 91–93% nt-id. of parts of y4rI to chromosomal sequences | |
| 369697 | 370887 | ISH-2f | y4rJ | 370012–370328: 72% nt-id. to ISH-2c1 370479–370785: 73% nt-id. to ISH-2c2 | | y4rJ: Tnp from IS1111a of *Coxiella burnetii* (IS1111A/IS1328/IS1533 family) |

TABLE 4-continued

Insertion/mosaic sequences in pNGR234a

| start of region | stop of region | name of region | put. ORFs/ ORF-fragments included | similarities within pNGR234a | similarities to chromosome | homologous sequences in other organisms/comments |
|---|---|---|---|---|---|---|
| 371399 | 372990 | ISH-8e | y4rL*M* | 371399–371671: 88% nt-id. to ISH-8f 371474–372228: 97% nt-id. to ISH-8d | | |
| 377185 | 377695 | ISH-10j | fr4 | similar to y4rG (ISH-10i) | | 377327–377695: 75% nt-id. to ISRm6 (*R. meliloti*) |
| 377826 | 380383 | NGRIS-2b | y4sABC | identical to NGRIS-2a | | partially 88–90% nt-id. to repetitive sequence RFRS9 of *R. fredii* USDA257 (IS1111A/IS1328/IS1533 family) |
| 380883 | 383523 | NGRIS-5c | y4sDE | identical to NGRIS-5a/b | copie(s) on the chromosome | 1stA and B Tnps) of IS1326 from *E. coli* (IS21/IS1162/IS408 family) |
| 383593 | 384054 | ISH-2g | fs5 | | | Tnp of IS1328 of *Y. enterocolitica* (IS1111A/IS1328/IS1533 family) |
| 384210 | 384493 | ISH-10k | | | | fragments with 94–84% nt-id. to ISRm6 (*R. meliloti*) |
| 388100 | 388600 | ISH-2h | fs1 | | | different Tnps (IS1111A/IS1328/IS1533 family) |
| 388601 | 388900 | ISH-10l | fs2 | | | ORF from IS1312 of *Ag. tumefaciens* (IS66/866 family) |
| 396445 | 397301 | NGRIS-9 | y4sN and fs4 | | 91–99% nt-id. of NGRIS9-parts to chromosomal sequences | different ORFs derived from IS elements; partially known from acc. no. X74314 |
| 400626 | 403248 | NGRIS-3c | y4tAB | identical to NGRIS-3a/b | copie(s) on the chromosome | 62% nt-id. (over 2352 nt) to IS1162 of *Ps. fluorescens* (IS21/IS1162/IS408 family) |
| 426525 | 428102 | ISH-18b | y4uE* | 427651–428102: 83% nt-id. to ISH-18a | 77–96% nt-id. of ISH-18b-parts to chromosomal sequences | Tnp of mini-circle DNA from *Str. coelicolor* (IS110 family) |
| 429860 | 430007 | ISH-8c | fu3 | | | 85% nt-id. to ISRm5 (*R. meliloti*) |
| 430568 | 432851 | ISH-1e | y4uHI | | | 60% nt-id. to IS408/IS1162 (*Ps. cepacia*/*Ps. fluorescens*) |
| 433222 | 433560 | ISH-24a | fu4 | low similarity to y4sN (NGRIS-9) | | 79% nt-id. to ISRm4 (*R. meliloti*)/ISR12-like |
| 462554 | 463053 | ISH-10f | | | | fragments with 83–69% nt-id. to IS866 (*Ag. tumefaciens*) |
| 524946 | 525892 | ISH-8d | y4zA | 525095–525849: 97% nt-id. to ISH-8e | | 524946–525580: 61% nt-id. to ISRm5 (*R. meliloti*) |
| 526051 | 527121 | ISH-25 | y4zB* | | | Tnp of IS5376 from *B. stearothermophilus* (IS4 family of transposases) |
| 530364 | 531249 | ISH-1f | fz4, fz2 | 79% nt-id. to part of NGRIS-5 | | fz4/2: IS21/IS1162/IS408 family |

Abbreviations: Tnp = transposase; Int = integrase; nt-id. = nucleotide-identity; aa-id. = aminoacid identity
IS elements with precisely defined borders are designated as NGRRS/NGRIS-1 to 9. Other sequences which show homologies to known mosaic or IS-like sequences (mosaic/insertion sequence homologs) are named MSH and ISH, respectively.

Carbohydrates are constituents of the rhizobial cell wall as well as morphogens called Nod-factors (short tri- to penta-mers of N-acetyl-D-glucosamine, substituted at the non-reducing terminus with C16 to C18 saturated or partially unsaturated fatty acids). Elements of the biosynthetic pathways leading to cell walls or to lipo-chito-oligosaccharides (Nod-factors) are common. Most differences are found in the later stages of the pathways that lead to specific cell-wall components or to Nod-factors.

As befits a symbiotic replicon, only 13 ORF's with homology to polysaccharide synthesis genes (house-keeping genes senso stricto) are located on the plasmid (Table 3). Sequences homologous to exoB, exoF, exoK, exoL, exoP, exoU, and exoX (X. Perret and V. Viprey, unpublished), and exoY (Gray et al., 1990) are clearly located on the chromosome. Although loci with weak homologies to nod-box::psiB of *R. leguminosarum,* and exoX of *R. meliloti* exist on the plasmid (y4iR, and y4xQ respectively), these are regulatory rather than structural genes, suggesting that almost all cell wall polysaccharide synthesis ORFs are chromosomally located.

Except for nodPQ and nodE, at least one copy of all the regulatory and structural ORFs involved in Nod-factor biosynthesis seem to be located on the plasmid. The activity of most nodulation genes is modulated by four transcriptional regulators of the lysR family. These are nodD1 (y4aL), syrM1 (y4pN), nodD2 (y4xH), and syrM2 (y4zF). NodC, which is an N-acetylglucosaminyltransferase. the first committed enzyme in the Nod-factor biosynthetic pathway, is part of an operon which includes nodABCIJnolOnoeIE (y4hI to y4hB, Table 3). Together, these genes, which form the hsnIII locus, are responsible for the synthesis of the core Nod-factor molecule, and the adjunction of 3- (or 4)-O-carbamoyl, 2-O-methyl, and 4-O-sulfate groups (Hanin et al., unpublished). nodZ (y4aH), which encodes a fucosyltransferase, is part of the hsnI locus, which includes noeJ (y4aJ), noeK (y4aI), noeL (y4aG), nolK (y4aF), all of which are involved in the fucosylation of NodNGR factors (Fellay et al., 1995a). Wild-type NodNGR factors are also N-methylated and 6-O-carbamoylated, adjuncts which are added by the transferases encoded by nodS and nodU respectively [y4nC and y4nB; hsnII (Lewin et al., 1990)]. Possibly the only other enzyme which may be directly involved in Nod-factor biosynthesis is that encoded by nolL (y4eH, Table 3). As the 2-O-methylfucose residue of NGR234 Nod-factors is either 3-O-acetylated, or 4-O-sulphated, an acetyltransferase is obviously required. Since NolL shows only limited homology to acetyltransferases, experimental proof of the transferase activity will be required however.

In contrast to *R. leguminosarum* and *R. meliloti* harbouring pNGR234a, *A. tumefaciens*(pNGR234a) transconjugants are incapable of nitrogen fixation (Broughton et al., 1984), suggesting that some essential fix ORFs are also carried by the chromosome Nevertheless, more than 40 nif- and fix-ORFs are plasmid borne. Included amongst these are nifA (y4uN) which encodes for a sigma-54 dependent regulator. Mutation of rpoN (which encodes sigma 54) causes a $Fix^-$ phenotype on NGR234 hosts (van Slooten et al., 1990). Similarly, mutation of fixF (y4gN) disrupts synthesis of a rhamnose-rich extra-cellular polysaccharide, and results in a $Fix^-$ phenotype on *Vigna unguiculata,* the reference host for NGR234 (unpublished). In fact, loci adjacent to fixF are probably responsible for the synthesis of dTDP-rhamnose from glucose-1-phosphate. Enzymes involved in this biosynthetic pathway include glucose-1-phosphate thymidylyltransferase (y4gH), dTDP-glucose-4,6-dehydratase (y4gF), dTDP-4-dehydrorhamnose-3,5-epimerase (y4gL), and dTDP-4-dehydrorhamnose reductase (y4gG). Rhamnose-rich lipopolysaccharides (LPS) seem to be necessary for complete bacteroid development and nitrogen fixation (Krishnan et al., 1995). Perhaps the enzyme encoded by y4gI is needed for the synthesis of the rhamnose rich LPS's from dTDP-rhamnose.

Although not directly involved in the fixation process, mutation of the plasmid borne copy of dctA (=dctA1, y4vF) also impairs nitrogen fixation (van Slooten et al., 1992). Other nif- and fix-ORFs are involved in elaboration of the electron-transfer complex (fixAB), in various cofactors required for nitrogen fixation (e.g. fixC, nifB, nifE, nifN, etc.), and in the synthesis of ferrodoxins (fdxB, fdxN, fixX). Finally, those ORFs involved in the synthesis of the nitrogenase complex are also present. Amongst these are two functional copies of the nifKDH ORFs (y4vM to y4vK and y4xC to y4xA) (Badenoch-Jones et al., 1989). Additionally, 17 new ORFs located within the nitrogen fixation cluster (see FIG. 7; ORFs y4vC to y4vJ with the exception of dctA1, y4wA to y4wG, y4wI, y4wJ and y4xQ) are co-transcribed together with the ORFs homologous to known nif and fix genes. It thus seems likely that most ORFs necessary for bacteroid development and synthesis of the nitrogen-fixing complex, are carried by pNGR234a.

Two types of regulatory elements which frequently occur in pNGR234a are the NodD- and NifA/sigma-54-dependent promoters. NodD-dependent promoter-like sequences known as nod boxes have been identified by homology search within intergenic regions, using the following consensus sequence: 5'-YATCCAYNNYRYRGATGNNNNYNATCNAAACA ATCRATTTTACCAATCY-3' [12 mismatches allowed (van Rhijn and Vanderleyden, 1993); Y=C or T, R=A or G, N=A,C,G or T]. Putative NifA-dependent promoters (Fischer, 1994) have been predicted by screening for the NifA activator sequence (5'-TGT-$N_{10}$-ACA-3') together with the sigma-54 promoter consensus sequence (5'-TGGCAC-$N_5$-TTGCA/T-3' with GG and GC as the most conserved doublets; 3 mismatches allowed) separated by 60 to 150 nucleotides. The identified conserved promoter-like sequences in pNGR234a are listed in Tables 5 and 6.

TABLE 5 nod box-like sequences in pNGR234a

| nod box | position in pNGR234a | orien-tation | number of mismatches to the consensus sequence | distance to the following ORF | name of the following ORF |
|---|---|---|---|---|---|
| 1 | 4514–4562 | – | 11 | 504 | (fal) |
| 2 | 8481–8529 | – | 8 | 87 | nodZ |
| 3 | 12322–12370 | – | 7 | — | ?# |
| 4 | 97470–97518 | – | 6 | 277 | nolL |
| 5 | 129615–129663 | + | 10 | 1358 | y4gE |
| 6 | 141088–141136 | + | 8 | 890 | fixF |
| 7 | 150280–150327 | – | 11 | 202 | noeE |
| 8 | 158820–158868 | – | 4 | 235 | nodA |
| 9 | 161891–161939 | + | 11 | 1103 | y4hM |
| 10 | 169833–169881 | – | 7 | 117 | y4iR |
| 11 | 278947–278995 | – | 7 | 153 | nodS |
| 12 | 279821–279869 | + | 7 | — | ?# |
| 13 | 443101–443149 | – | 10 | 465 | y4vC |
| 14 | 473059–473107 | + | 9 | 236 | y4wH |
| 15° | 481253–481301 | – | 16 | 117 | y4wM |
| 16 | 493961–494009 | + | 6 | 288 | y4xI |
| 17 | 532039–532087 | + | 5 | 589 | syrM2 |
| 18 | 256434–256482 | + | 12 | 329 | y4mC |
| 19 | 469151–469199 | + | 12 | 112 | y4wE |

°The majority of the mismatches is located in the 3'-terminal part of the sequence.
#No predicted ORF can be found downstream of the putative nod box.

TABLE 6

Putative NifA-dependent promoters in pNGR234a

| Nr. | NifA-dep. UAS*: position | sigma-54 pro-moter (–12/–24 region#): position | orien-tation | distance to the following ORF (nt) | name of the following ORF |
|---|---|---|---|---|---|
| 1 | 90812–90827 | 90910–90924 | + | 127 | y4eD |
| 2 | 162727–162742 | 162788–162802 | + | 240 | y4hM |
| 3 | 235036–235051 | 234934–234948 | – | 66 | y4lD |
| 4 | 255021–255036 | 255130–255144 | + | 306 | y4mB |
| 5 | 285265–285280 | 285343–285357 | + | 50 | y4nG |
| 6 | 436363–436378 | 436275–436289 | – | 41 | nifB |
| 7 | 442046–442061 | 441955–441969 | – | 56 | fixA |
| 8 | 442735–442750 | 442676–442690 | – | 40 | y4vC |
| 9 | 444109–444124 | 443983–443997 | – | 104 | y4vD |
| 10 | 444137–444152 | 444241–444299° | + | 38° | nifQ |
| 11 | 451782–451799 | 451891–451905 | + | 88 | nifH1 |
| 12 | 460319–460334 | 460424–460438 | + | 63 | y4vR |
| 13 | 463063–463078 | 463139–463153 | + | 48 | y4wA |
| 14 | 478839–478854 | 478761–478775 | – | 463 | nifS |
| 15° | 483663–483678 | 483769–483783 | + | 88 | nifH2 |

*"Upstream Activator Sequence": NifA-binding site located 80 to 150 nt upstream of the transcription start point (5'-TGT-$N_{10}$-ACA-3').
#sequence corresponding to the consensus sequence of conserved sigma-54-promoters 12 nt upstream of the transcription start point: 5'-TGGCAC-$N_5$-TTGC-3' (2 mismatches allowed).
°3 possibilities for a promoter (in two cases only corresponding to the minimal consens: 5'-GG-$N_{10}$-GC-3')

EXAMPLES

Example 1

General Methods

Bacteria and Plasmids

*Escherichia coli* was grown on SoC, in TB or in two-fold YT medium (Sambrook et al., 1989). The cosmid clones pXB296 and PXB110 (Perret et al., 1991) were raised in *E. coll* strain 1046 (Cami and Kourilsky, 1978). Subclones in M13mp18 vectors (Yanisch-Perron et al., 1985) were grown in *E. coli* strain DH5αF'IQ (Hanahan, 1983).

Construction of Cosmid Libraries

Cosmid DNA was prepared by standard alkaline lysis procedures followed by purification in CsCl gradients (Radloff et al., 1967). DNA fragments sheared by sonication of 10 μg of cosmid DNA were treated for 10 min at 30° C. with 30 units of mung bean nuclease (New England Biolabs, Beverly, Mass., USA), extracted with phenol/chloroform (1:1), and precipitated with ethanol. DNA fragments, ranging in size from 1 to 1. 4 kbp, were purified from agarose gels using Geneclean II (Bio101, Vista, Calif., USA) and ligated into SmaI-digested M13pm18. Electroporation of aliquots of the ligation reaction into competent *E. coli* DH5αF'IQ was performed according to standard protocols (Dower et al., 1988; Sambrook et al., 1989).

M13 Template Preparation

Fresh 1 ml *E. coli* cultures in twofold YT held in 96-deep-well microtiter plates (Beckman Instruments, Fullerton, Claif., USA) were infected with recombinant phages from white plaques grown on plates containing X-gas (5-bromo-4-chloro-indoyl-β-D-galactoside) and IPTG (isopropyl-β-thiogalactopyranoside). Rapid preparation of ~0.5 μg of single-stranded M13 template DNA was carried out as follows: 190 μl portions of the phage cultures grown for 6 hr at 37° C. were transferred into 96-well microtiter plates. Lysis of the phages was obtained by adding 10 μl of 15% (w/v) SDS followed by 5 min incubation at 80° C. Template DNA was trapped using 10 μl (1 mg) of paramagnetic beads (Streptavidin MagneSphere Paramagnetic Particles Plus M13 Oligo, Promega, Madison, Wis., USA) and 50 μl of hybridization solution [2.5 M NaCl, 20% (w/v) polyethylene glycol (PEG-8000)] during an annealing step of 20 min at 45° C. Beads were pelleted by placing microtiter plates on appropriate magnets and washing three times with 100 μl of 0.1-fold SSC. The DNA was recovered in 20 μl of water by a denaturation step of 3 min at 80° C. When required, larger amounts of single-stranded recombinant DNA (>10 μg) were purified using QIAprep 8 M13 Purification Kits (Qiagen, Hilden, Germany) from 3 ml of supernatant of phage cultures grown for 6 hr at 37° C.

Sequencing

Two sequencing methods were used: dye terminator and dye primer cycle sequencing, each in combination with AmpliTaq DNA polymerase (Perkin-Elmer) and Thermo Sequenase (Amersham). All reactions, including ethanol precipitation, were performed in microtiter plates. Reagents were pipetted using 12-channel pipettes. Where necessary, sequencing reaction mixtures, including enzymes, were pipetted into the plates in advance and held at −20° C. until needed.

Dye Terminator Cycle Sequencing

For dye terminator/AmpliTaq DNA polymerase sequencing, 0.5 μg of template DNA, and the PRISM Ready Reaction DyeDeoxy Terminator Cycle Sequencing Kit (Perkin-Elmer) were used. Cycle sequencing was performed in microtiter plates using 25 PCR cycles (30 sec at 95° C., 30 sec at 50° C., and 4 min at 60° C.). Prior to loading the amplified products on electrophoresis gels, unreacted dye terminators were removed using Sephadex columns scaled down to microtiter plates (Rosenthal and Charnock-Jones, 1993).

Dye terminator/Thermo Sequenase sequencing was performed using the same experimental conditions except that the reaction mix contained 16.25 mM Tris-HCl (pH 9.5), 4.0 mM $MgCl_2$, 0.02% (v/v) NP-40, 0.02% (v/v) Tween 20, 42 μM 2-mercaptoethanol, 100 μM dATP/dCTP/dTTP, 300 μM dITP, 0.017 μM A/0.137 μM C/0.009 μM G/0.183 μM T from Taq Dye Terminators (Perkin-Elmer; no. A5F034), 0.67 μM primer, 0.2–0.5 μg of template DNA, and 10 units of Thermo Sequenase (Amersham) in a 30 μl reaction volume. Unincorporated dye terminators were removed from reaction mixtures by precipitation with ethanol.

Dye Primer Cycle Sequencing

Dye primer/AmpliTaq DNA polymerase sequencing reactions were performed according to the instructions accompanying the Taq Dye Primer, 21M13 Kit (Perkin-Elmer). Cycle sequencing was carried out on 0.5 μg of template DNA with 19 PCR cycles (30 sec at 95° C., 30 sec at 50° C., and 90 sec at 72° C.) followed by six cycles, each consisting of 95° C. for 30 sec and 72° C. for 2.5 min. Prior to electrophoresis, the four base-specific reactions were pooled and precipitated with ethanol.

Identical PCR conditions and the Thermo Sequenase Fluorescent Labelled Primer Cycle Sequencing Kit (Amersham) were used for dye primer/Thermo Sequenase sequencing reactions.

Sequence Acquisition and Analysis

Gel electrophoresis and automatic data collection were performed with ABI 373A DNA sequencers (Perkin-Elmer). After removing cosmid vector and M13mp18 sequences from the shotgun sequence data, the data were assembled using the program XGAP (Dear and Staden, 1991) and edited against the fluorescent traces. To close remaining gaps, to make single-stranded regions double-stranded, and to clarify ambiguities, additional cycle sequencing reactions with selected shotgun templates were carried out using either custom-made primers (primer-walks) or universal primer.

The complete double-stranded DNA sequence of cosmid pXB296 was analyzed using programs from the Wisconsin Sequence Analysis Package (version 8, Genetics Computer Group, Madison, Wis., USA). Homology searches were performed with BLAST (version 1.4; Altschul et al., 1990) and FASTA (version 2.0; Pearson and Lipman, 1988). Several nucleotide and protein databases were screened (GenBank/Genpept, SwissProt, EMBL, and PIR). Identities and similarities between homologous amino acid sequences were calculated with the alignment program BESTFIT (Smith and Waterman, 1981).

Example 2

Comparison of Fluorescent Traces Created by Different Cycle Sequencing Methods

When using a thermostable sequenase [Thermo Sequenase (Amersham)], the concentrations of dye terminators (Perkin-Elmer) can be reduced by 20- to 250-fold in comparison to the concentrations needed for Taq DNA polymerase without compromising the quality of the sequencing results (Table 7).

To compare the dye terminator and dye primer cycle sequencing procedures, representative templates derived from the pXB296 library were sequenced by both methods, each performed with Thermo Sequenase and Taq DNA polymerase

TABLE 7

Concentrations (In μM) of dye terminators in each cycle sequencing reaction with two different thermostable DNA polymerases

| Dye terminator | AmpliTaq DNA polymerase | Thermo Sequenase DNA polymerase | Dilution factor for dye terminators[a] |
|---|---|---|---|
| A Taq | 0.751 | 0.017 | 40 |
| C Taq | 22.500 | 0.137 | 160 |
| G Taq | 0.200 | 0.009 | 20 |
| T Taq | 45.000 | 0.183 | 250 |

[a]Thermo Sequenase vs. AmpliTaq.

(FIG. 1). In general, dye terminator traces do not contain the many compressions (on average, one compression every 50 bases in single reads) that are common with dye primers if mixes do not contain nucleotide analogues like deoxyinosine or 7-deaza-deoxyguanosine triphosphates or if sequencers are used without active heating systems. In addition, dye terminator traces obtained with Thermo Sequenase show more uniform signal intensities over those obtained with Taq DNA polymerase, thus resulting in a reduced number of weak and missing peaks (e.g. a weak G-signal following an A-signal in Thermo Sequenase traces or a weak C-signal following a G-signal in Taq DNA polymerase traces). Using ABI 373A sequencers, errors in automatic base-calling of Thermo Sequenase/dye terminator scans only arise after 300–350 bases. The average number of resolved bases in dye primer gels (378 bases) is 46 bases longer than in those produced with dye terminators (332 bases). Furthermore, in Thermo Sequenase/dye primer sequences the peaks are very regular and the number of stops and missing bases decreases in comparison to Taq DNA polymerase/dye primer electropherograms. The number of compressions, however, is not significantly reduced.

Example 3

Shotgun Sequencing of Entire Cosmids Using Dye Terminators or Dye Primers

To compare the efficiency of both methods, cosmid pXB296 of pNGR234a was shotgun sequenced using a combination of dye terminators and thermostable sequenase (Thermo Sequenase), whereas another cosmid, pXB110, was sequenced using a combination of dye primers and Taq DNA polymerase (Table 1). Over 93% (736 clones) of 786 dye terminator reads of pXB296 were accepted by XGAP with a maximal alignment mismatch of 4%. By increasing this level to 25%, so that most of the remaining data could be included in the assembly, 775 reads led to three 6 to 10 kbp stretches of contiguous sequence (contigs), two of which were joined after editing. To close the last gap and to complete single-stranded regions with data derived from the opposite strand, only 32 additional dye terminator reads using custom-made primers were required. It took <1 week to assemble and finalize the 34,010 bp DNA sequence of pXB296 (EMBL accession no. Z68203; eight-fold redundancy; GC content, 58.5 mol %).

In contrast, only 308 (34%) of 899 shotgun reads obtained by Taq DNA polymerase/dye primer cycle sequencing of pXB110 were included in the first assembly (4% alignment mismatch). At the 25% alignment mismatch level, 879 reads were assembled, leading to 25 short contigs (1–2 kbp). These contigs had to be edited extensively in order to join most of them. "Primer walks", covering gaps and complementing single-stranded regions, were not sufficient to clarify all the remaining ambiguities in the assembled sequence. Every 100–150 bp, a compression in one strand could not be resolved by sequence data from the complementary strand. Therefore, it was necessary to resequence clones using dye terminators and universal primer. In total, 191 additional dye terminator reads had to be created. As a result, assembling and finalizing the 34,573 bp sequence of pXB110 (10.5-fold redundancy; GC content, 58.3 mol %) took much more time than pXB296 did.

Example 4

Analysis of Cosmid pXB296

Putative ORFs were located on the 34,010 bp sequence of pXB296 using the programs TESTCODE (Fickett, 1982) and CODONPREFERENCE (Gribskov et al., 1984), the latter in combination with a codon frequency table based on previously sequenced genes of Rhizobium sp. NGR234 (as well as the closely related *R. fredii*). All 28 ORFs and their deduced amino acid sequences exhibited significant homologies to known genes and/or proteins. The positions of the ORFs along pXB296, as well as the best homologues, are displayed in Table 2 and FIG. 2. Ribosomal binding site-like sequences (Shine and Dalgarno, 1974) precede each putative ORF except for ORF9 (position 11,214–12,455). If one disregards the homology to known glutamate dehydrogenases in the first 32 amino acids deduced from this ORF, a downstream alternative start codon (position 11,220) preceded by a Shine-Dalgarno sequence can be identified. Most of the ORFs are organised in five clusters (ORFs with only short intergenic spaces or overlaps between them). Cluster I, containing ORF1 to ORF5, encodes proteins homologous to trans-membrane and membrane-associated oligopeptide permease proteins and to a *Bacillus anthracis* encapsulation protein. Cluster II, includes ORF6 and ORF7, which are homologous to aminotransferase and (semi)aldehyde dehydrogenase genes. Homologies to transposase genes [ORF8; cluster III (ORF10 and ORF11)] and to various nif and fix genes [cluster IV (ORF12 to ORF20); ORF23, part of cluster V] are also reported.

Presumed promoter and stem-loop sequences that might represent ρ-independent terminator-like structures (Platt, 1986) are shown in FIG. 2. Significant $\sigma^{54}$-dependent promoter consensus sequences (5'-TGGCACG-$N_4$-TTGC-3'; Morett and Buck, 1989), as well as nifA upstream activator sequences (5'-TGT-$N_{10}$-ACA-3'; Morett and Buck, 1988), are found upstream of the nifB homologue ORF15, the fixA homologue ORF20, ORF21, ORF22, and ORF23. ORF23 is part of cluster V in pXB296, which includes the dctA gene of Rhizobium sp. NGR234 (van Slooten et al., 1992). Surprisingly, the published dctA sequence shows important discrepancies. Therefore, a fragment encompassing this locus was amplified by PCR using NGR234 genomic DNA as template. By sequencing this fragment, the cosmid sequence of the present invention was confirmed.

Example 5

Analysis of the Complete Plasmid pNGR234a

Using the thermostable sequenase/dye terminator cycle sequencing method herein described, 20 overlapping cosmids (including pXB296) of the symbiotic plasmid pNGR234a of Rhizobium sp. NGR234 were sequenced, together with two PCR products and a subcloned DNA fragment derived from cosmid pXB564 that cover two remaining gaps (position 276,448–277,944 and position 480,607–483,991). The map of the sequenced cosmids is shown in FIG. 4. The entire assembled 536 kb sequence of pNGR234a is given in FIG. 3 (deposited in EMBL/GenBank under accession no. U00090).

The analysis of the complete nucleotide sequence revealed few regions of 98–100% identity to already published sequences in public databases. These sequences are listed in Table 8. These sequences had been derived either from Rhizobium sp. NGR234, derivatives of it or closely related strains of it. Therefore, the ORFs and their deduced proteins, 98–100% homologous to nifH, nodA, nodB, nodC, nodD1, nodS, nodU, nolX, nolW, nolB, nolU and "ORF1", represent already known genes/proteins (Table 8 and References). Some other ORFs and their deduced proteins, nearly identical to public database entries, were either only partially known before the disclosure of the present invention or exhibited significant differences, for instance, dctA, host-inducible gene A, nifD, nifK, nodD2, nolT, nolX, nolV, "ORF140", "ORF91", "RSRS9 25 kDa-protein gene" (Table 8 and References).

As a first step, approximately 100 kb of pNGR234a was analyzed between position 417,796 to 517,279 using the programs TESTCODE (Fickett, 1982) and CODONPREFERENCE (Gribskov et al., 1984). In this initial ~100 kb of sequence, 76 ORFs were found and ascribed putative functions (=ORFs y4tQ to y4yO (excluding ORFs y4uD, y4uG, y4wG, y4wO, y4wP, y4xF, y4xQ, y4xG and y4yB and excluding ORF-fragments fu1, fu2, fu3, fu4, fv1 and fw1); see Table 3). It should be noted that since the sequence of cosmid pXB296 forms part of this 100 kb region, all of the ORFs identified in Table 2 (except "ORF1") are reproduced (albeit with minor, but definitive, revisions) in Table 3. Most of the 76 ORFs and their deduced proteins showed homologies to public database entries that could help identify their putative functions. Only ORFs y4vK and y4xA (duplicated nifH) as well as y4yD, y4yE and y4yG (nolW, nolB and nolU) were identical to database entries (98–100% homology). In the case of 7 ORFs and their deduced proteins, no homologous sequences in public databases have been found.

predicted in addition to the 76 ORFs (y4tQ to y4yO) listed within Table 3.

According to Table 8, 12 ORFs of the 416 predicted coding regions were identical to public database entries (98% to 100% homology at the amino acid level), namely: y4hI (nodA), y4hH (nodB), y4hG (nodC), y4aL (nodD1), y4nC (nodS), y4nB (nodU), y4sM (ORF1), y4vK (nifH1), y4xA (nifH2), y4yD (nolW), y4yE (nolB), y4yG (nolU). In addition, the database entry of the homologue to y4yC

TABLE 8

All ORFs that show 98–100% identity in the nucleotide sequence to ORFs located in pNGR234a and that have already been published in databases:

| ORF | organism | EMBL/GeneBank accession no. | + claimed in the patent application/ – not claimed in the patent application |
|---|---|---|---|
| dctA | Rhizobium sp. NGR234 | S38912 | + sequencing mistakes in the database entry: the real dctA in pNGR234a is 144 bases longer (see table 4) |
| host inducible geneA | *Rhizobium fredii* USDA 201# | M19019 RFIND | + significant difference in pNGR234a (frameshift; see table 4) |
| nifH | Rhizobium sp. ANU 240* | M26961 RHMNIFKDH3 | – |
| nifD (partially) | Rhizobium sp. ANU 240* | M26961 RHMNIFKDH2 | + only part of nifD is in the public database |
| nifK (partially) | Rhizobium sp. ANU 240* | M26961 RHMNIFKDH1 | + only part of nifK is in the public database |
| nodABC | *Rhizobium fredii* USDA 257# | M73362 RSNOD2 | – |
| nodD1 | Rhizobium sp. mpik 3030* | Y00059 RSNODD1 | – |
| nodD2 | *Rhizobium japonicum* US6A 191# | M18972 RHMNODD2M | + significantly different function of NodD2 in NGR234 than in USDA 191 (despite of 98% identity°) |
| nodS | Rhizobium sp. NGR234 | J03686 NGRNOIDSU | – |
| nodU (partially) | Rhizobium sp. NGR234 | J03686 NGRNODSU | – |
| nodU (full) | Rhizobium sp.* | X89965 RSNODUGEN | |
| nolXWBTUV | *Rhizobium fredii* USDA 257# | L12251 RHMNOLBTU | – nolXWB, nolU<br>+ NolT: 97% identical (amino acid sequence level)<br>+ NolX, NolV + ORF4 of pNGR234a show significant differences to USDA257 (see table 4) |
| ORF1; ORF2 (partially) | Rhizobium sp. NGR234 | X74314 RSORF | – |
| ORF140 nodulation gene; ORF91 (partially) | Rhizobium sp. NGR234 | X74068 RSPLAS | + database entry includes sequencing mistakes causing frameshifts |
| RFRS9 25 kDa protein gene* | *Rhizobium fredii* USDA 257# | U18764 RFU18764 | + repetitive element in pNGR234a showing insertions, deletions of nucleotides in comparison to the database entry |

*strains representing derivatives of NGR234: Rhizobium sp. ANU 240, Rhizobium sp. mpik 3030, Rhizobium sp.
#strains closely related to NGR234: *Rhizobium fredii* USDA 257, *Rhizobium japonicum* USDA 191, *Rhizobium fredii* USDA 201.
°identity in nucleotide sequence as well as amino acid sequence As a second step, the remaining 436 kb of pNGR234a were analyzed using the methods noted above. The results of this analysis are discussed in Example 6.

Example 6

Genetic Organization of the Complete Plasmid pNGR234a

In order to confirm and to improve the identification of probable coding regions in pNGR234a, the program GeneMark was used which is based on matrices developed for related organisms of Rhizobium sp. NGR234 (*R. leguminosarum* and *R. meliloti* (Borodovsky et al., 1994)). The use of this program currently represents the most frequently applied method to distinguish coding and non-coding regions in newly sequences DNA of prokaryotes. Further analysis of the putative ORF products was carried out using methods to detect signal sequences, transmembrane segments and various other domains (PROSITE database search (Bairoch et al., 1995); PSORT program (Nakai et al., 1991)).

In total, 416 ORFs were predicted to encode putative proteins (Freiberg et al., 1997). Additionally, 67 fragments were detected that seemed to be remnants of functional ORFs. Some of these were disrupted by insertion of mobile elements. All identified functional ORFs and fragments of former functional ORFs are listed in Table 3.

Within the initial ~100 kb region (position 417,796 to 517,279) first analyzed in this study, 9 ORFs (y4uD, y4uG, y4wG, y4wO, y4wP, y4xF, y4xQ, y4xG and y4yB) and 6 ORF-fragments (fu1, fu2, fu3, fu4, fv1 and fw1) were (nolX) has been corrected to 98% identical to y4yC. Furthermore, the sequence of the ORF y4hB (noeE) has been available to the public since October 1996. Except the 14 ORFs mentioned above, the remaining 402 ORFs are new. 139 of them show no homology to any known ORF/protein. The others exhibit less than 98% amino acid identity to public database entries over their whole length.

Industrial Applicability

The present invention provides a detailed analysis of the symbiotic plasmid pNGR234a of Rhizobium sp. NGR234. The plasmid pNGR234a (including any ORFs encoded therein, or any part of the nucleotide sequence of the plasmid, or any proteins expressible from any of said ORFs or any part of said nucleotide sequence) has industrial applicability which can include its use in, inter alia, the following areas:

(a) the analysis of the structure, organisation or dynamics of other genomes;

(b) the screening, subcloning, or amplification by PCR of nucleotide sequences;

(c) gene trapping;

(d) the identification and classification of organisms and their genetic information;

(e) the identification and characterisation of nucleotide sequences, amino acid sequences or proteins;

(f) the transportation of compounds to and from an organism which is host to at least to one of said nucleotide sequences, ORFs or proteins;

(g) the degradation and/or metabolism of organic, inorganic, natural or xenobiotic substances in a host organism;

(h) the modification of the host-range, nitrogen fixation abilities, fitness or competitiveness of organisms;

(i) obtaining a synthetic minimal set of ORFs required for functional Rhizobium-legume symbiosis;

(j) the modification of the host-range of rhizobia;

(k) the augmentation of the fitness or competitiveness of Rhizobium sp. NGR234 in the soil and its nodulation efficiency on host plants;

(l) the introduction of desired phenotype(s) into host plants using said plasmid as a stable shuttle system for foreign DNA encoding said desired phenotype(s); or (m) the direct transfer of said plasmid into rhizobia or other microorganisms without using other vectors for mobilization.

REFERENCES

Altschul, S. F., G. Warren, W. Miller, E. M. Myers, and D. J. Lipman. 1990. Basic local alignment search tool. *J. Mol. Biol.* 215: 403–410.

Appelbaum, E. R., D. V. Thompson, K. Idler and N. Chartrain. 1988. *Rhizobium japonicum* USDA1 191 has two nodD genes that differ in primary structure and function. *J. Bacteriol.* 170: 12–20.

Badenoch-Jones, J., T. A. Holton, C. M. Morrison, K. F. Scott and J. Shine. 1989. Structural and functional analysis of nitrogenase genes from the broad host-range Rhizobium strain ANU240. *Gene* 77: 141–153.

Bender, G. L., M. Nayudu, K. K. L. Strange and B. G. Rolfe. 1988. The nodD1 gene from Rhizobium strain NGR234 is a key determinant in the extension of host-range to the non-legume *Parasponia. Mol. Plant-Microbe Interact.* 1: 259.

Bodmer, W. F. 1994. The Human Genome Project. *Rev. Invest. Clin.* (Suppl.) 3–5.

Broughton, W. J., M. J. Dilworth, and I. K. Passmore. 1972. Base ratio determination using unpurified DNA. *Anal. Biochem.* 46: 164–172.

Broughton, W. J., N. Heycke, H. Meyer z. A., and C. E. Pankhurst. 1984. Plasmid-linked nif and "nod" genes in fast growing rhizobia that nodulate *Glycine max, Psophocarpus tetragonolobus,* and *Vigna unguiculata. Proc. Natl. Acad. Sci. USA.* 81: 3093–3097.

Broughton, W. J. C-H. Wong, A. Lewin, U. Samrey, H. Myint, H. Meyer z. A., D. N. Dowling, and R. Simon. 1986. Identification of Rhizobium plasmid sequences involved in recognition of Psophocarpus, Vigna, and other legumes. *J. Cell Biol.* 102: 1173–1182.

Buikema, W. J., W. W. Szeto, P. V Lemley, W. H. Orme-Johnson, and F. M. Ausubel. 1985. Nitrogen fixation specific regulatory genes of *Klebsiella pneumoniae* and *Rhizobium meliloti* share homology with the general nitrogen regulatory gene ntrC of *K. pneumoniae. Nucleic Acids Res.* 13: 4539–4555.

Cami, B. and P. Kourilsky. 1978. Screening of cloned recombinant DNA in bacteria by in situ colony hybridization. *Nucleic Acids Res.* 5: 2381–2390.

Craxton, M. 1993. Cosmid sequencing. *Methods Mol. Biol.* 23: 149–167.

Dear, S. and R. Staden. 1991. A sequence assembly and editing for efficient management of large projects. *Nucleic Acids Res.* 19: 3907–3911.

Davis, E. O. and A. W. B. Johnston. 1990. Regulatory functions of the 3 nodD genes of *Rhizobium leguminosarum* bv. *phaseoli. Mol. Microbiol.* 4: 933–941.

Dower, W. J., J. F. Miller, and C. W. Ragsdale. 1988. High efficiency transformation of *E. coli* by high voltage electroporation. *Nucleic Acids Res.* 16: 6127–6145.

Fellay, R., P. Rochepeau, B. Relić, and W. J. Broughton. 1995. Signals to and emanating from Rhizobium largely control symbiotic specificity. In Pathogenesis and host specificity in plant diseases. *Histopathological, biochemical, genetic, and molecular bases* (ed. U. S. Singh, R. P. Singh, and K. Kohmoto), Vol. I, pp. 199–220. Pergamon/Elsevier Science Ltd., Oxford, U.K.

Fickett, J. W. 1982. Recognition of protein coding regions in DNA sequences. *Nucleic Acids Res.* 10: 5303–5318.

Fischer, H.-M. 1994. Genetic regulation of nitrogen fixation in Rhizobia. *Microbiol. Rev.* 58: 352–386.

Fisher, R. F. and S. R. Long. 1993. Interactions of NodD at the nod box: NodD binds to two distinct sites on the same face of the helix and induces a bend in the DNA. *J. Mol. Biol.* 233: 336–348.

Fleischmann, R. D., M. D. Adams, O. White, R. A. Clayton, E. F. Kirkness, A. R. Kerlavage, C. J. Bult, J. F. Tomb, B. A. Dougherty, J. M. Merrick, et al. 1995. Whole-genome random sequencing and assembly of *Haemophilus influenzae* Rd. *Science* 269: 496–512.

Fraser, C. M., J. D. Gocayne, O. White, M. D. Adams, R. A. Clayton, R. D. Fleischmann, C. J. Bult, A. R. Kerlavage, G. Sutton, J. M. Kelley, et al. 1995. The minimal gene complement of *Mycoplasma genitalium. Science* 270: 397–403.

Freiberg, C., X. Perret, W. J. Broughton and A. Rosenthal. 1996. Sequencing the 500-kb GC-rich symbiotic replicon of Rhizobium sp. NGR234 using dye terminators and a thermostable sequenase: A beginning. *Genome Research,* in press.

Gribskov, M., J. Devereux, and R. R. Burgess. 1984. The codonpreference plot: Graphic analysis of protein coding sequences and prediction of gene expression. *Nucleic Acids Res.* 12: 539–549.

Hanahan, D. 1983. Studies on transformation of *Escherichia coli* with plasmids. *J. Mol. Biol.* 166: 557–580.

Hartl, D. L. and M. J. Palazzolo. 1993. Drosophila as a model organism in genome analysis. In *Genome research in molecular medicine and virology* (ed. K. W. Adolf), pp. 115–129. Academic Press, Orlando, Fla., U.S.A.

Hiles, I. D., M. P. Gallagher, D. J. Jamieson, and C. F. Higgins, 1987. Molecular characterization of the oligopeptide permease of *Salmonella typhimurium. J. Mol. Biol.* 195: 125–142.

Iismaa, S. E., P. M. Ealing, K. F. Scott, and J. M. Watson. 1989. Molecular linkage of the nif/fix and nod gene regions in *Rhizobium leguminosarum* biovar *trifolii. Mol. Microbiol.* 3: 1753–1764.

Levy, J. 1994. Sequencing the yeast genome: An international achievement. *Yeast* 10: 1689–1706.

Lewin, A., E. Cervantes, C.-H. Wong and W. J. Broughton. 1990. nodSU, two new nod genes of the broad host range Rhizobium strain NGR234 encode host-specific nodulation of the tropical tree *Leucaena leucocephala. Mol. Plant Microbe Interact.* 3: 317–326.

Long, S. R. 1989. Rhizobium-legume nodulation: life together in the underground. *Cell* 56: 203–214.

Long, S., J. W. Reed, J. Himawan and G. C. Walker. 1988. Genetic analysis of a cluster of genes required for synthesis of the calcofluor-binding exopolysaccharide of *Rhizobium meliloti. J. Bacteriol.* 170: 4239–4248.

Makino, S.-I., I. Uchida, N. Terakado, C. Sasakawa, and M. Yoshikawa. 1989. Molecular characterization and protein analysis of the cap region, which is essential for encapsulation in *Bacillus anthracis. J. Bacteriol* 171: 722–730.

Martinez, E., D. Romero, and R. Palacios. 1990. The Rhizobium genome. *Crit. Rev. Plant Sci.* 9: 59–93.

Morett, E. and M. Buck. 1988. NifA-dependent in vivo protection demonstrates that the upstream activator sequence of nif promoters is a protein binding site. *Proc. Natl. Acad. Sci. USA*. 85: 9401–9405.

Morett, E. and M. Buck. 1989. In vivo studies on the interaction of RNA polymerase-$\sigma^{54}$ with the *Klebsiella pneumoniae* and *Rhizobium neliloti* nifH promoters: The role of nifA in the formation of an open promoter complex. *J. Mol. Biol.* 210: 65–77.

Padmanabhan, S., R.-D. Hirtz, and W. J. Broughton. 1990. Rhizobia in tropical legumes: Cultural characteristics of Bradyrhizobium and Rhizobium sp. *Soil Biol. Biochem.* 22: 23–28.

Pearson, W. R. and D. J. Lipman. 1988. Improved tools for biological sequence comparison. *Proc. Natl. Acad. Sci.* 85: 2444–2448.

Perego, M., C. F. Higgins, S. R. Pearce, M. P. Gallagher, and J. A. Hoch. 1991. The oligopeptide transport system of *Bacillus subtilis* plays a role in the initiation of sporulation. *Mol. Microbiol.* 5: 173–185.

Perret, X., W. J. Broughton, and S. Brenner. 1991. Canonical ordered cosmid library of the symbiotic plasmid of Rhizobium species NGR234. *Proc. Natl. Acad. Sci. USA*. 88: 1923–1927.

Perret, X., R. Fellay, A. J. Bjourson, J. E. Cooper, S. Brenner, and W. J. Broughton. 1994. Subtraction hybridization and shotgun sequencing: A new approach to identify symbiotic loci. *Nuclei Acids Res.* 22: 1335–1341.

Platt, T. 1986. Transcription termination and regulation of gene expression. *Annu. Rev. Biochem.* 55: 339–372.

Radloff, R., W. Bauer, and J. Vinograd. 1967. A dye-buoyant-density method for the detection and isolation of closed circular duplex DNA: The closed circular DNA in HELA cells. *Proc. Natl. Acad. Sci. USA*. 57: 1514–1521.

Relić, B., X. Perret, M. T. Estrada-García, J. Kopcinska, W. Golinowski, H. B. Krishnan, S. G. Pueppke and W. J. Broughton. 1994. Nod factors of Rhizobium are a key to the legume door. *Mol. Microbiol.* 13: 171–178.

Rosenthal, A. and D. S. Charnock-Jones. 1993. Linear amplification sequencing with dye terminators. *Methods Mol. Biol.* 23: 281–296.

Sambrook, J., E. F. Fritsch, and T. Maniatis. 1989. *Molecular cloning: A laboratory manual,* 2nd ed., Cold Spring Harbor Laboratory Press, Cold Spring Harbor, N.Y., U.S.A.

Shine J. and L. Dalgarno. 1974. The 3'-terminal sequence of *Escherichia coli* 16S ribosomal RNA: Complementary to nonsense triplets and ribosome binding sites. *Proc Natl. Acad. Sci.* 71: 1342–1346.

Smith, T. F. and M. S. Waterman. 1981. Identification of common molecular subsequences. *J. Mol. Biol.* 147: 195–197.

Stanfield, S., L. Ielpi, D. O'Brochta, D. R. Hesinki and G. S. Ditta. 1988. The ndvA gene product of *Rhizobium meliloti* is required for Beta(1-2)glucan production and has homology to the ATP binding export protein HlyB. *J. Bacteriol.* 170: 3523–3530.

Sulston, J, Z. Du, K. Thomas, R. Wilson, L. Hillier, R. Staden, N. Halloran, P. Green, J. Thierry-Mieg, L. Qiu, et al. 1992. The *C. elegans* genome sequencing project: A beginning. *Nature* 356: 37–41.

Tabor, S. and C. C. Richardson. 1995. A single residue in DNA polymerases of the *Escherichia coli* DNA polymerase I family is critical for distinguishing between deoxy- and dideoxyribonucleotides. *Proc. Natl. Acad. Sci.* 92: 6339–6343.

van Rhijn, P. and J. Vanderleyden. 1995. The Rhizobium-plant symbiosis. *Microbiol. Rev.* 59: 124–142.

van Slooten, J. C., T. V. Bhuvanasvari, S. Bardin, and J. Stanley. 1992. Two $C_4$-dicarboxylate transport systems in Rhizobium sp. NGR234: Rhizobial dicarboxylate transport is essential for nitrogen fixation in tropical legume symbioses. *Mol. Plant Microbe Interact.* 5: 179–186.

Yanisch-Perron, C., J. Ira, and J. Messing. 1985. Improved M13 phage cloning vectors and host strains: Nucleotide sequences of M13mp18 and pUC19 vectors. *Gene* 33: 103–119.

Bairoch A., P. Bucher, and K. Hofmann. 1995. The prosite database, its status in 1995. *Nucleic Acids Res.,* 24 189.

Borodovsky, M. Y., K. E. Rudd and E. V. Koonin. 1994. Intrinsic and extrinsic approaches for detecting genes in a bacterial genome *Nucleic Acids Res.* 22: 4756.

Broughton, W. J., U. Samrey, and J. Stanley. 1987. Ecological genetics of *Rhizobium meliloti:* symbiotic plasmid transfer in the *Medicago sativa rhizosphere FEMS Microbiol. Lett.* 40: 251.

Fellay, R., X. Perret, V. Viprey, W. J. Broughton, and S. Brenner. 1995a. Organization of host-inducible transcripts on the symbiotic plasmid of Rhizobium sp. NGR234*Mol. Microbiol.* 16: 657.

Freiberg, C., R. Fellay, A. Bairoch, W. J. Broughton, A. Rosenthal, and X. Perret. 1997. Molecular basis of symbiosis between Rhizobium and legumes. *Nature,* 387: 394–401.

Gray, J. X., M. A. Djordjevic, and B. G. Rolfe. 1990. Two genes that regulate exopolysaccharide production in Rhizobium sp. strain NGR234: DNA sequences and resultant phenotypes*J. Bacteriol.* 172: 195.

Hanin, M., S. Jabbouri, D. Quesada-Vincens, C. Freiberg, X. Perret, J.-C. Prome, W. J. Broughton, and R. Fellay. 1996. Sulphatation of Rhizobium sp. NGR234 Nod factors is dependent on noeE, a new host-specificity gene *Mol. Microbiol.,* in press.

Krishnan, H. B., C.-I. Kuo, and S. G. Pueppke. 1995. Elaboration of flavonoid-induced proteins by the nitrogen-fixing soybean symbiont *Rhizobium fredii* is regulated by both nodD1 and nodD2, and is dependent on the cultivar-specificity locus, *nolXWBTUV Microbiology.* 141: 2245.

Morrison, N. A., C. Y. Hau, M. J. Trinick, J. Shine and B. G. Rolfe. 1983. Heat curing of a sym plasmid in a fast-growing Rhizobium sp. that is able to nodulate legumes and the nonlegume Parasponia sp. *J. Bacteriol.* 153: 427.

Nakai, K. and M. Kanehisa. 1992. Expert system for predicting protein localization sites in Gram-negative bacteria. *PROTEINS: STructure, Functions, and Genetics* 11: 95–110.

Piper, K. R., S. Beck von Bodman, and S. K. Farrand. 1993. Conjugation factor of *Agrobacterium tumefaciens* regulates Ti plasmid transfer by autoinduction *Nature* 362: 448.

Sullivan, J. T., H. N. Patrick, W. L. Lowther, D. B. Scott, and C. W. Ronson. 1995. Nodulating strains of *Rhizobium loti* arise through chromosomal symbiotic gene transfer in the environment *Proc. Natl. Acad. Sci.,* 92: 8985.

van Slooten, J. C., E. Cervantes, W. J. Broughton, C.-H. Wong, and J. Stanley. 1990. Sequence and analysis of the rpoN sigma factor gene of Rhizobium sp. strain NGR234 *J. Bacteriol.* 172: 5563.

van Slooten, J. C., T. V. Bhuvanaswari, S. Bardin, and J. Stanley. 1992. Two C4-dicarboxylate transport systems in Rhizobium sp. NGR234: rhizobial dicarboxylate transport is essential for nitrogen fixation in tropical legume symbioses *Mol. Plant-Microbe Interact.* 5: 179.

Zhang, L-H., P. J. Murphy, A. Kerr, and M. E. Tate. 1993. Agrobacterium conjugation and gene regulation by N-acyl-L-homoserine lactones *Nature* 362: 446.

SEQUENCE LISTING (1 sequence)

SEQ ID NO: 1 - DNA, 536165 bp, Rhizobium
gatctcgattggcagaaccggcaccgcgcgccagctaactacgccatagagcgcgagcaggaagcgcgtgagtacgttgctgttggcggcgccgccgcgcgcgcggatcgcctcgcgcgccttcaccatatgagccgcgtcgacggaatcaccgatcatcttgagcgcgaagtaagacttcacgcttgcgctcatatcgaagggcccgtcatgcaccagcggccagccgccgtgcgcgccttgagtgcggcgcagataatttccgattttggcttcgagcacgacgtcaatgggctcggccaggtaatgacgtagcaggatgtattcggaagggatggtggaatccgcttcaagctcgaacgcccaatggccgtcggcatgacgataagcgagcagcgcctcagtggctgaggcgatgctcatttccagcgcggcgggatcgatggcagtgcgatttccggaatgcttattcactgacttcctgcgtgttcggcagcgtgcaaaaccgtctggatttatcaatcaagtgtttgtctctgaaagagccagatcggcggcacggttacccgaccgcaccgatccctcgatggttgccggcaaaccggttgcggtccagtcgccagcaaggaacaggtttttgcaaccggtcacgggccctggacgtagcgcgttctgctccggggtggcctggaatgtggcccggcgctcacacacgatctgccacggcggcagctcgcctgagatcccaccggcctcgcacacgtcgcgccagatcactcgcacgacctcctcacgcggaatgtcaagcaggcggtcgccattgctaatggtgactgaaagccgctgcggataggcgaacagccactccacgagcccgccgaccacgcccaggatcggatccgcaccgactggcggatcgaagcgaaaatgggcattaacgacggcgcggaattcggtcggggttttcaggccgggcaggagcgtcgcggccgcccgtggcggcacggcgaggatcacggcgtcgtcggggccgaccgctatcttgtcgtcaccgaaatcaagttcgctgatgatctcggccgatttggcaagcttgcgcagtttatggctgaggcggacggtggcgccccgcctctccaggagcttgaccgccggctcgaccagaacggcgctcagtccgtcgcgcgcgactagcggacggcaagcctcgccgcccgcgagcagcgtttcccgtacgatggcaccggcaagccctgccgagccctccggcggatcgcaattcagggcggcgagcagcagcggccgcaccagacgccggtacagcgtaccattgcagggtatagtgtttccgaccagttcatccgcgccggcccataggattggcgcgagcttcaggtagtcccacagcctggtgtcggggacgcgacgcgccttgtggaacacccaggtcggaagcctgccgccgccgagatcgacctgccagcgctgtacggtggagatgtcgacgaagggaaacttggcactcgtcggaccgacaagaccggattccgttccgatcgcacgggcgtagttgcgcacatattggttgcccgatagaaccagatggttgccgttgtcgatggtgagattggttgcggaatcgaaaaaggagcggcatcgaccgccggcctgttgcgtcgcttcatagacatgcaccggcaaacctgcattgctcaactgcacggccgcggaaaggccggagatcccggcgccgataatgtgaacattttttggcatcacaacatcaaggcgtaacggaagagaatggcgcgctttgtgagattggttacacgcaccggttcccggggagccgcaaaaccccttatcagcagcaggtccaagatcgcgcggtaacatttggacatgatggtgggggcgcgtactattctgcgcgggttgcaattcatgatctcgtcggattcggcaaaatgcatcatcgcgcgttgggccagcggtgcgcacgccttgggcagcgccttgtcggcgatgactttatgtgggtcgctgctggtgataccggcgtgatcgaggctttcgcgtggtatatagagccgacccagcccagcatcctcgtctatgtcgcgcaggatgttggtgagttgcagcgcacgaccgaggtgatgcgcaagtgcaatgccatcctcctcgctcaagccgaacacacgcaccgacatccttcccacggcgctggcgacacggtcgcaatagagatccagggttgccattttgggcgcgcggatgtcttgtagtacgtccatttccatgccgtcgacaacggctaggaaatcctctcgcttcagcccgaaggtcgttaccgaggcgagatagtcctttagccgcggcggcggtacacattggtagagcgcgtcaatgtgatcgcgccattgctgaagtgcagcaaggcggtgctcgcgcggttcgtcggagtcggcgatgtcgtcgacctggcggcagaagctgtagatctggaatatcgcctcgcgctgcaccggcgggagggtacgcattcccagatagaacgagctgccaagggccgtagagcggtggttcgcgtgggccgccgcctccgccctcatacgtcgacagtcgtcttgaatcgcgtaccgcggccgaacgcacggcgcgcggcttcgtttgccattgcgccgacgccatggagcagcagctcaagcggcgacagatgcacgcgctcccttagaggatcgcgcatcttcagcatcgacacgatcttatcggcaaaagacagtatgacggagacctcgaaccggaggcgaaagtccttcacctgcgacaccagcgctccgcccccgttgagcagcacctcggccttcgctgcgagagagcgcaggcattgtagcatctgcaacgaggattttgcggcgcccagctcttcgatggaggcgccgctggctgaaagcgcatcgcgcggaatatagacgcgattgagattaaggaaatccttgccgcaatcctgcaggtggttacagacctgcagtcccgcgcacaacacatccgatgccggccacgtcgcggcactttcgccgtggacgtcgagcacaaatcggccgaccggcatcgccgagtatcggcaataatcgatcacctcgtcccagttctcgtaacgctgcttagtcacgtccattcggaaggcggtgagcagatcgagtgcatgacgcggcggcatgccgcgtcggtcaagcgcagtgcgtaggtgtacagcttctgctcgcgtttcgcccttgccgagcagctcggcttccaggaggtcgaggtacagaagcttctcgtctggcgcgagcgtcgcgtgatcggcaatgtcatcggccatgcggacgaatcggtagaaggcaagaatcagcgctcggtgccgcggatggataatccacgacgcaacggggaaatttttctcgcggtgcattgcgtccgacctggggccgctgccgctcgtcatttagcaccatcgtcggttttgcaggcgttggatgctgctgaaatgcagtcgggcccccgaataaatcgtacaatccacgaaggtacggcggcggccaaagacgttatcgaccggcgcgcgtttttatccccgagaattatccgatgcgaatctgtttttcgagtatactgattcgttctgacgaattctttgctgaaagcgtcggatgagactatatcccagtagctaaaggcgattcgactaccgcgcattatgaatacaccacatccctgccatgcaaacatatcccaccactcaattattacgcggtcatcttcttcgtagatgaactccggagcgcaaatcctctccgcaatggcgcgatttggtcgaaaaatcttttggattgccgcgcgtcctatcacggggcgctgcatcggccagaggctcattgcattttcgtggtacagctcagccaaagcgatcgcatcacccttattgaatcgtcgaatccactcttcgaccgtcccgcgcgcgctcattgaaatgctcctttctcaagacctttgctaccatcggtccgtcaggatccggcattttccagctgtcgattcgatagccagagggatatcgcccgactcgatccccaaacataatgaggcacaaagcggcgcacagcgattgctgtgcgagcataagcgccgcgtttcgttcgttcagtcattgcaggtgatgtccacggtgatcactcgatgccgcttctaaaagcgatcggtgcaccttcaacgaaagtcgcggagccccacgcagcgtggagaaactcgcgtatgggtcactggacgggttgtggccgtgttttttgtaggaaaccgcgactttggcaaagctcgaactcaccctctcagttgcgcgcgcgacgcccttttcaggcacggcaccggcccacgctagtgttgctgaaatacaaccgtgatccgagtggaaaagcggtccaccggaagagctaaatcagatgtatttttcaccagagtttcacatagtctcgctttattgaaatccattttttcaatgacataaatctatacggtagattcacagccgagtatgcttcagccacaggcggttctgcagtcagaacgtcgcggttctcaatttgaggagttatcagtgatgtttaagacagaacgaggctgcgatcgtgaaggaatggatgagcgttttttcgagtgcggtgtcgcgcgagaccggtgcgccactggcagacagtgtaggtcatcgctgctccggtcaatgtcacggcgaagaccggcacttgtcctggggccggcggcgcctatccactgggaacaacggcggtcgagcgggcctgtttctacctgccaatgcgagcctgatcacccgtaccggcgctgtagtcggctccgagtgcagcgttcaggcaggcggtatattttcacggccccccgtccgccgtcgattacgatgctgcatcttcaggcggcacaaatcttgcgccgacgaaccgcgaactcgtcgacgccgttgatgagcgggtaggggtgatcgcggaagagaccgggcggccagacgtttgcggaacgcacaagcgactcgcccgtgacccgcaggccgatggtgtgggagggagcggcgccgtggggcgtctttgcaaaccggtgtcagtgccagagtcgcgacccgccttaattatcagccacattgctgacaaacgattcataggatttggccagtcccagctcgagcgaggtcttcgggcgccaacccatcgacacgagtctttcgctagataaaagctttcgtggcgttccgtccggcttggatgtgtcgaagactatatcgcctttaaaaccaacaacacggcagacgatgtgggctagttcaatgatacttatttcccccccggagcctatgttaatgtgttccgtttcggaataatgcttaagtaggaagaccagggcgtcggagcagtcttcactgtacaaaaagtctcgagtaggtgtgccgcttccccatatagacaagcacccaaggtctttaatctttgcctcatgtgctttgcgtattaaggcagggacgacgtggctggagttaagatcgaacttatcgcgtgggccatagagatttgtcggcatggctgatatgaagtttgcgccgtattgcttacgatacgcttgacacaacttaatgccggcgattttggcgatcgcataccactcgttggtcggctcaagtggtccggttaatagagcctcttcccttatgggctgcgccgcatacttcggatatatgcaactcgatccaaggaaaagaagcttttcaacgccactgcggaaggagccctcaatgacattagcctccatgataaggttttgatagatgaagtcagcgggcatagtatcatttgccaggatcccacccaccttcgctgccgccattatgaccgcgtgcggcttttcctttaatagaaatttctcaacttcctcttgccgcgtcagatcaagcttttgcctatctgcaacgatgacttcgcaatcctcggaggcaagcgatcgaattatggcgctgccgaccatacctttgtgtcctgcgacccaaatacgctttccgtctagcaaatacatcggcatctcgcctcttactgtcgggtgcccctcaaataagagagatcttcccttaccatttcgcaagcaagatctctcacacttgtctcgtgcctccagcccaaaacctgccgggccttggtggcatcgcctaaaagtaaatctacttccgtgggcctgaaatagcgcggatccaccgcaacgacgcatctgcctgtcgcggcgtctatgcccctttcttcaatgccttctcccacccattcaatcgtcattccggtttcctcgaaggcccattcgacaaacgtgcgaaccgatgttgtcaccccggtagccaggacatagtcgcctggtctatcctgttgacacatcatccacatgccccgcacatactcacgggcatgtccccagtcacgttgagcatctagatttccaagataaaggacctcttgtttacctagactgattgccgctgcagcccgggtgatcttgcgagtcacgaacgtctccccacgaagcggactttcgtggttgaaaagaataccgttggaggcatgcatgccgtaagcctctctataatttacgacaatccagtacgcgtacagctttgcggccgcgtagggtgaacgcgggtagaatggcgtcttttcgttttgggggctctcttgagccagcccatatagctctgaagtcgatgcctgataaaagcgagtccgattggtcagcccaagaatccgaatagcttccagcatgcgcaatgtaccaattgcatcggcgtttgcagtgtactcgggggtttcgaagcttacctgaacgtggctttgcgctgcaaggttgtagatctcatgcggctgggtttgctgaacaatgcgcagcaaattggtcgaatccgtcatatccccatagtggagaaaaaatctcgcttcaggatcgtgacgttcttgataaatgtgctctatccgttgagtgttgaatgatgacgaacgacgctttatgccgtgaacaatatagccttcgtccaacagcagttcagcaagataagccccatcctgacccgttacgccagatattaaagctactttccggtctgtcactttgtcgaatctccagtgatattcctgcgggagagggcgtgcgctagggcagctggtgtgaaggaaatcgtcgtgcttcggcgacagagcgggcctatggaggcattgcggttttcaaagcagtattgccggagacgtgcgggccggggcaactgggcatgaggcgctcgtgtcccttggagcgcgcccaagtttctccatgactgctcttcaccacgcctagaattgaggtgacgattttcattcaagaggcggtatttgttgaagatctttcgatcacgaccaggcgactaggatcgttcagatcaaactcaataacccttgggacagaaaggcgtgcgtaacgtgtaaaggcgcttgtcggaggaaaccgaatgacggtgtcgcaaagcccaagaagatacatctcgacgagggcggaaattccgccctcaaccccgagatctgcgctgtgtaatgggccagactgatccgctcggaaacttttcgggatcgtgagaagatcggggaacctactcgacacctggtccaatacccgcgcgctatcggtgcacaaaatcacccgcacaggcttcgggtggggcaacgctttggcagcattaatggcagtgcacacttgatgcacggcaaggtccggatcggcccagtagggtgcatggtccataacgtcttcgccgttaccatgccgaacatgaaccccgatcgcactgtacccatagaagtgctcctgatagatagcgtctatgcgagcctgaatttcagcccgaggcttgacactgcagaaaatctgccgctctgcctcctcgtcgcagcgccacatcaaacacgcatcacacactaccgtgttggcctcgacatcatcttgggcctggaaaagttcatcgagttcgtctcgctctcgaaaaacctgagcatctgggcggtaaacacattcaatcgcaggtttattccaccaatttgggaagaatggtcctgggaaggaaaactcgttgacccggttatcgcaaataaaagggacacctgcgatatccttgattggttcaaaaaacaccggaaaggcgtttgtgaagggctgatcaaggtagcaggacccgcgccagtcaacggctaacgttcgcgccgtcctttgggcgtagcgccaagcggccgccagcgaccacagacagtcaccgaaaccagtacgtctccgagagaggacatatcgattgtacaatgctgcccgtccttagtgccgccgctctgacttactgtcttctacggatttccaatcaattcagagcttcctaatggagttcggcaacatcagtaaaatttatattttgaatggcaaccatccacatattggatgtaaaggggacgtgtctttcagggcttatcttcacgttaggtggcgaaccatcgacgctagcggtaacagatctgcatatcagcaaagcctaacttacaccattgaactgttaaggaccgccagtccctgagccagcaaatgttcggcagcatctgggtcgtctgcctcgacgtagcaacgcagttcaggcgcatttcctgaagggcggatgtgcaggatacggccgccttcaaatgtcaggcgcaggccatccacgtcgtccgtgcccgccacgcgaccgatccggctgaataaatgggaaacattagcttttgacgctttcaagaatgccactagggcgtcgctcctatcgaacggatagttctcgatccggccggacaaagcgactggcaaacgatgcatcgcgacgatccccgagaggggagttttggcctctactgccatgtggagcgctgcaatgatgggaaggacgcagtcccgggtcggcaaggcgggaagcgacgcgcctccgaacgagaagttcgaacctagcatgacgccaccgttggcctcgaagcccatcacccgctgcttgccacgggcaaccgcctcagtcatggctgcaatgacgtaaggtgagccaacgcgggtacgcaccacctcgacgccactcgccgcctcgatcccggagttgctggttattggcgtagcaataagcttggcctccagcagccttgcgcaaataagaccgagcagatcaccgcgcaatggagttcccgtttcatccgttagcaggggccgatcggcatctgcgtcggacgatacaatggcgtcaaaggcgaactccttcgcccaggcagcgagcatcttacatgtcgccgccgaaatagcttccgtgtcaacagggatgaagacctcagatcggcctaccggtacgacatttgcgccatgaccttccaagatggtggtcaaaatatcgcgggcaacgctgctgtgctgatataagccgatctttagccccttaaggcccgattttggaagcagcgtttcgtaacgttggatatagaagtcagttgcttcgctggagtggtcggcgccgcggccacactcaaccctggttgcatctgcatcggctgaaagctgctccgccaacgccgtaatcgcctgctcgtcggccttgttgatctcaccgtcaggcagatagaacttaatgccgtttcggtcggccggaatatgcgagcctgtgatcatgagtgatgctgcaccgagttttcggccgtacaatgcaagcgctggtgtcggcagccctccgcagtcgaccggcaccattcccgcccgggcgagcgccgccatgcagatagcggcgatttccgaacttgaatcgcggaagtcgcgaccgaccaatacggtcgcccctggcgcgacccgtcctctgtcgaggagcatcctcgaaaaggctgtagcatagagcgccgacacactacccacgagttctgttgccaacccgcgcagaccacttgtgccgaatttgggacccattaactagcctttttttgccgggcagcgttcagcaggtagtcgacgccaccggggcaagccgaatgaattcgcatccactaatgagattgcttcgctctcgccacactgttatgaagcttccatcaaacgcaatcaaaaatgacaccatgcttccaaagattatcccagctatcatggcagggggtaggggcacaaggctctggcctctgtcacgcgcaactgccgcaaaacagtttctaaagctaatcggcgaggaaacgctctttcaagacacgcttaagcgcgtttccgatgccaaagtttatggagcaccactcgtcatcacaaatgaggaatttcgcttcctggttgccgaacaggcgcgcgagctcggggtcacgctttccagcatagtacttgagccggtgccgcgcaacacggcagccgcagtagccgtcgccgcccggatcgtggctgatcggtttggtgaggacgcgctattgcttgtgctgccgtcggaccacgcgattacggtagacgatacttacaagaaatgcgtgcgctccgcctgcatcgccgcagcggagggcaagctcgtgacgttcggtattcaacccacttggccagcaacaggatacggatacatcgaacgtggcacttaccttggcaaggacgtccatgcggttcaatgttttgtcgagaaaccaagtctcgaaaaggcggcggctcttttggagaccggcaattactattggaactctgggatgttccttttccaggcggccagcattatcgccgaacttgaggaacatgcacccgacgtgttgtcggcggtgcacgccgcggtcaggggctcaacggtcgacgccgattttatacgacttgccccggagagtttcagccaagcgccatccatctcgatcgactatgcactgatggagaaaaccgcaaacgccgccgtggtctgctcggattttgcttggtcggatctcggtagttgggatgctgtatggaagaatgaggagcagaatgctgatggtaacgtgctcaagggcaatgttacggcctgcaacacgaagaattcgcttgtgttgtcgcataccgcgcatctcgctgtacaggggatggatggagttgcagtcatcgctagcgaggacgcagtcttcgtcgggcgactggaggaggcccatgagatcggaaacttggtgaagcgcctcgccgcggacgaaaatacggcacgtcttacggaattgcacccaactttgatacggccatggggcggctacaccactatgcttaacggcgatcgcttccaagtaaggcggttgttcgtacgccctgggaagatgctttctctccacaagcattttcatcgatcagagcactggatctgcgtgaagggcaccgcagaagtgacaatcgaggatcgagtaacgatcctgcacgagaaccagtcaatctacatccccgagggggcgatacatcgcttgggcaaccctggcaagatcatgctggagttggtcgagattcaaactggtgcctacctgggcgaggacgatatcatccgcgtcgcagacgaatcgagaaatgaaatgccagattcgaggcgtacgggcccatagggatagcgtgccctttgcgcagtccggcaccttcgcacgcattacggtatctggagcgaggacgtggtggcaccatcggcaagcgttgcaccggcggccgcggacgggtctgacgacatgcgatggataccgccctctgcgtcgacacgatcgtagatgcgtgttctcctccgtgggcccggcacgatcgttctcctgcgcaacgcatacctcgcgacgaggtaggccgaaaaatccggctttcttcgcgcgcagcatttcgagacgacctttctcgacgggcagatcgcccggcgtctgcgacccgtccggcttctttttctttgagcggtttctcgcagcagcaccgcttgcacgcggctccattccggctttttttaccgacagatcagctatgcgcttgaagcgctgcttgccgtcccgtctggcggaaggcccgcgaggaacggcgaaaaggcggcgccgaagcccctgcattgttagtggcaaggctgttgcggtgggcgttgacggtttcgctccggctcgatccctacggtcgaaaagacgaaatggcaggagcggtcggccgttttgccacaaagcctgttcttcaggaggcgcatgcaagagggcgggcgacggcatgaagccgtgaatgcacttgacttcagattaattaagcgttttctaacgatttgcataattgatcgttcggatgacaaccatccgcactgtggattcgccagaacatgcgttttaagggccttgatctcaatctcctcgttgcgctcgacgcactgatgaccgaacgcaaactcacggccgctgcacgcagcatcaacctgagccagccggcgatgagcgcagccatcacccggcttcggacctatttccgcgacgagctatttaccatgaatggtcgcgaacttgtaccaactccgcgagcagaagcgctcgcacccgcagtccgcgaagccctgctgcacatccatctctccatcatttcatgggatccgttcaacccagcgcagtcagatcgcagtttcaggatcattctttccgacttcatgacgctaatgtttcttgaaagggttgtggtgagagtggcgcgggaagcgcccgccgtcagtttcgagttgctgccgttttccgatgagccagatgagcttctccggcgtggtgatgtcgatttcctgatcctgccagaaatgttcatgtcgcacacgcatcccagagcgaagctgttcgatgagagattcgtgtgcgtgagctgcccaacgaaccagaagctaccgccgcagctctccatcgacaactatgtatcaatggggcatgttgcggcccaattcgggaagcagcggccttccgtggaggaatggctattgcgcgagcacggattgcgaagacgggtcgaagtcgccgtgccgggttttaccatgatcccgtcttttttgtcgggcactgaccgcatagcgaccctcccgttacgactggcgatgcacttcgcaaaagccattcccctgcggatcaccgaacttccgcaacccatttttcccgcgttcaccgaggctgtccagtggcccgcgcctcacagcagtgatccggccagtctctggatgcgcgagatatttctacaggaggcgtctcgcgttgaatttcaatccgaaacttcggcgcatgctctatctaaagccgacggcgcaattcgccacccttgagcccgcaactgcacggtcggctcagggtcgagcagtttggctgcaggttgcggcctaccagaggggctcgcacggcccgagcgtaccgcatgccacactccgaccattttcggcctatgcgcagcattagctcttcagcttcagcagccgggagaccatctcattcagcgtgatatccttcgatacctcgatcaaaccgcgcatgggcattaaggcgaggttcctactgtccgccatgctacaagtcactcgcaagttgcccttccggacgctcccaatccagccaatttgcggtcggaacgccaatccaaccgcctcgcagcagcctccgccgacagcccgttccgtcttcgatactcggctctgaagatcgtgactcagtgctcttccattgcctcctgattctaagaaaagaaccgagactgcggacacggagatgcctcaattgagttgctcactttggagttgagctgtatcaaacgggtgccctcgacaaaggccatattcgatatagcggatcccagtaaatcattggtgaaacgatccttcaccaggagtaagtgtgttgagtgttgaccctgagaagaaaagagccaaagcgaacgctgtggatatttacgtcggccgtcgaattcgccagaggcgacgatggcagaatatgtcccaagcggccctcggagaagctatcggggtgacgtttcagcaggtgcaaaaatatgaaaagggctcgaaccgggtaggtgcgggccgacttcagcagatatctgatgcactggaagtgcacccttcctatttttttgaggacatgcctgacgacactcagtcgatagggcagggcgcccctaatcaggcctatatcccgcccgaagtgattgagttcgctgcaagcgacgaaggggtcgagctcatccgggcgttctcccgtgtcggcaatctcaacgtgcgctgtcgaatcgtgaagctgctcaagtctctcggcgaacacgactggtaagcatgaattcgcccatttctgagtcgaacgcggctacgctctcggaatgaaatcaaccgtaagtgacatcgccatgggacgcttgcattgactctgtagctcattgagttcaaatcatacaagtgagctaggggaggaaatcacagtggctgacgagagtaacacaggaccagttgccgcggctgaggcggttgccgaaacgcaagcaccagctggcaaaaggaagagttcgtcgcggcgtcaaagaacggctgccggacaagttgcggaatcaaagacgactgctaagcctaagagatatagcgagacagaaagagctgacaagctcaatctgatcgaggccgaagtggctcaaggcaatagcaccctaaaggacgcgatcaagagcgccggcatatcggagcaaacctactacgtgtggaagaaatctgctaagcctgccgatcgaaaaccagaggagtctgtggtggccggcgatgaccttgccgatctcattcaactcgataaggaaaacttgaggcttcgcaaccttttgtcggacaaactgcgtgcggaaaacgccgaactgcgcaagagacttgggctggattagttcaagagtagcctctcaaggctgtggtaaggcgccctgccggcttccgaaagggacggcgtgcctagccttacggccacttgcatcgagtccgaaatggcggtatttggccgaatggtaaaggaatgtcgtggcgcgttttggcgctgatgagtcgtggattgcttgcgagatacatatgaaaacaccaccacggaggtttattgtcgaattcaagcaagcacggcggcgatcaaaggaacgaacgaattcagtctggggaaacacggaccttaaggctttgacccgcgaagtggaagagatggctccgcatttgttcaacttaacggaagagccagtatcccctaacgtagcctacggtccgccggccagcccgaatgcagagtttctcattgcagacaaagagaatatcgggcttgggccagaagccgtgacaccggccgaaggttcggaaaacgcgttctcggggctgttgcaggagacgccaccggtctcccacacccgaacaaactccaaacagcgcatttcgcgaaagctacccgagcggttgtcattggacgtgcgtgagaatgtagaacgcccgatttctcgcggtgaattggccactctcgaagcagaaaacaagcgcctcaaaaggctgctcgctgaacggatccttacccaaaacttgcaactcaagaagatgcttgatcggtttaacctcaattgacgatgtcgcatccgcgcgaaagtcttaggaatctcttgggggccggcgttttagcaatcgctgatagctcttcaatcccacctcaatgacacagttcaggaccttcctccatgtatctagccatagcacgccaaccgaatatattcaaacaaacctgagcctacggcagaattaatggttttttaatagacttggtagctgcggattaaaattatgttttgacatatcctcgatcggtgttaatccactaaatgagaagtgtcgtcgcagataaatactttgacgaaattccagcttgggttgtgattcttccctgttgctttgagccgtcagccagctcagcgccttggtggcggcttcccatcacgacttgagccttgatgttgcggcggagcctggctcctgtgcaatgaccgtccagtttcaagaggcaagtgagttcagcggcattttctcgcacgtttcctcctgaaacgtcgttttgggatatgttgctaagatccgataggagaagaagatgacagaaaccacgctcggtgcgagcaacgaacttttggcagaactgacggcagaaatcgtagccgcctatgtcagcacccacgtggttccgggtgccgagcttccgacgcttatcgctgacgttcattcagcgctcaacaatgccactgctcccgcgccggtgattgctcccattgagaagccgaagccagcggtctcgatccgcaagtctgtgcaggacgatcagatcacctgcctcgaatgcggcggcgccttcaagtcgctgaagcgccacttgatgacccaccacaatctgtcgccggaagattatcgcgaaaagtgggacctacccgcggactacccgatggtcgcgcccgcttatgcggaagcccgctcgcgtctggccaaggagataggcctcggcgagcgccgcaagcgtcgtggtaagtagaacgttatcgccggcggcgatcgctgccagctacgcgccacgcctttaatttgcgcgaaatgctatgcagaatgcggtgtttcggccgcaccttccagatgcacggcgtgattgacgaatgttgaccccgaacgaaagcttggacatatgtagatttcacagcttacgcttaaatccagcgatgacgagacggtgcgccgcttcaaggttttcattaatcttgtcgttggcgaagccgccaagttcaaccgtctcgatccggaggtccatcttcgagatatcctcacgcgcatcgccggccatccgatcaacaggcttgccgaatggttaccgcggagcatgcggcatcagggtcgaccatggccgggcctgccaacacgacactcatgcgcagcgcgcctgcggccttcctcggtggcggcgtcatcggcccgcctccgaagagccggtcagcttgacgacatcgacgaacttgcgtcgcgcgtgagcaaggcagaacgccagccgcatgggggcgacattgctctctcccatcacgcgcgccgacgcgggcgcttgcacaatgacgctttcaccggcccggcatgcatagcttggccggatcgtctgctttacccggacaaccgccggcacgatgtcgagcgcctcactgacgtccgtgccgacgcaatgaagctcgaacgagcagcacgggcaaatcttgctctccggctcgatgagctcttcataccgtgggaggtgcctgggtaaacggccgatgttgcgcgacggtgaccgtcgctcctgttttggcccttcagccacgggtgcaacatcgtcattggccgccgcgggaatgtcggtgagatcgccaaggtcaagcgtcgcctgcgtcgggtcgatcgccgtcatcttctccgatttcggcccaaagagctgctgctccaggaaggcaacgcgcgccttgaggtcggcgttctctgcatcaagcgagagaatgatccggctcaattgcgcggcatcctgaggtaaagagtcgggtcaaagcggcatggcagaccctagcacatgatcctgaatcttcaagcaaatccaataggatcagcccgctttcgtcggccgctttacgacgtttcgcttgcccgagtccagtcgataccggtcagcaaaaaatttgttcggccttgaaatgtacgttcgtctaacgtacagttggcttaaacgacatgaaggagccggtcatgcgagcaatcaaggacgtcacgattgacatcgatgagccgaacaccgttcgaatgaacttccgtacgaaggagcgcgtgaagaggacgatccagcgtgccgcggcactttccggcctcgacgattctgcgttcacgatcaacgctgcctaccagtctgccattgccacgatcgcggcgcatgaggcgaccttgttgcagacaacggactaccaggcgtttttcgacgctttggataatccgcccaaaccgaccgatcggctgagagacgcgttcaagcgttatagcgagaccgtagtctctaagtaatggcaaataccggcgccgcaaaacgcataatcgagccgctcgatcccaaccggcatgatcgggcggcttttttttgtggaatcatccaggtcgacaacttcttcaagaaaacggcgaacaagctatcgaaagcagacaaccttcgtgtctatgtgatgaccgaagacgatggcacaacggttatagggttctacgccatcaacagccactcgatcagctatgctgatctgccggaacgcttttcccgcacccggccgggacacggctcgataccggccgcctatatctccatgatcggtcgcgatcagcgatataggggtggcggttacggcggcgatctgcttaccgattgcctgcaaaggatcgccggaattgctgaccagattgggatcgccgtcgttcttctcgatgtccttgtttgcggtgacgaagaaaagacgagccggcgtgtcgcgctttacagcgaatatggctttcaacctttgccgtcaatgccgcttcggatgttcctgccgatcgcgacgatcaggagcctaatgggctaacgcgcattcggtgcgcgatgcacgcatttaattaagcgcaaaaagcaacagaaacaaaaccgctctgctgttccataagatagattatgcgatcattttttgtagcggcattttagagatgcgacatatgagccagttagagatgcgacggtcgtcgcctcttgggatgctggtcaaacgtcaacgtttggaaggaagactggcgacgggaagcgtggttgagaccatgagcgttcggagtcgtcatgtcttgtttgatcaccatgtcgcagaaggaattgcatcgtcttgaactgatccaacggattcgcggccgcagcctgaccgtcgtcgaggcggccgcgttgcttcgtctcagccgcagtcaggtgcaccggttgttgcaggcctatgacttggccggcgccgacggtctggtctcgaagaagcgcggccgtccgagcaaccggcgtcacagcgaggatttccgcaacctggtgctcgacctggtgcgtgagcattacctggattttggaccaaccctggcggccgagaagctgatcgaacgccaccggattgccgtcagcaaggagacgctgcgccaatggatgatggaagccggcatctgggtgtcgcgacgcgagcgcaagaagcgggtcttccagccgcgcggccggcgcgattgtttcggcgaactcgttcagatcgatggctcgcttcattggtggttcgagaaccgcggtcccaaatgcgccctgctcgtctatatcgacgatgccaccggcaagctcttgcatctgcggttcgccggatcggagaacaccttcgactatctgcacgcgacgaaggcctacttgcagcaatggggaaagccgatcgccttctacagcgacaagcatggcatcttccgcaccacccatgcttccaagaaggacagaaccagtggcctgacgcagttcggccgggctctttatgagctcaacatcgacatcatctgcgccaataccccgcaggccaaggagcggacatcacgatgcaccttgttggagtggttgagcgacaattaatctgggttgacggccaccatatcgactgccggcgcctttttcgagtctgacgttgcccggcggttcgtacaagtatcgatggttgctggcgtatcgatgacgcttgagagtgcctttgcgcccgagttggtgaacggtcgattcgcatacgccgagctgctgggctacttcctcgccggtgagcatgccgccctcgcgcagccgttcgtaccggctcttcaaaccataggtgcggcgcacgagcatgaccttcttcggcgtgaagggttcgccgcgccagttgcgatgcccgagttcgttgagacgagcggcgatctgccggtcgttggtggcctccagcagctcgttgatcaacgccacgacctgtgccggcgtcttgcgtatcaccgacataggccgaggtctggccaccgacaggctctgcgtgcgcccgccgcgccaacggatgttgatgttgacctcatcgtcgacgagcagcgtcacgtcttcgatgagaaggccgagcatgcgcttgcgttcgacggcaccggtgcgctcgtcgttccagatgcgcgggaaatcggcggtcagcgccctgatgcgctgctgcgctggctcgtccagcagcgagtggtcggcctcgttctggcgctcgtgctcgcgctggagtgcgtcgaggtcgcgcagccgtgcgttccagtcggcttccagcgcgtcggcgaccaggcggttgtccggatcgaccttcaggtagcgccggcgggccagttcagcctcatagcgggcgcgttgcagctgcgtgccgcgcagcgccgcggcctgctccacgcgctgggtgatctcctgctgcacggcaagcgcgacatcgatcgctgccggcgccattacctccagcagtagcgcgctcaccgcctcgtcgaccggagcaccgcgcacccattggcagtgtttgccggcgtgtcgcacgacggcttcgttgcagacgtaatatgggcgcagccgcccctcgaacggctcgtaatggacccgcatgcgtgcaccgcagcggccgcacagcagccgtccctgcaacaggccgctgccctggcggggcatgcgtccacgcaggccgggtgaaaaaccggtggcgttctgttccagggctgcctgattgcgttcgtattcggcccaggaaatgtagccgtcgtgggcgtcgggaatcagtacctgccagtcggatctcgccacgcgcagttgcacgggcttcagcttggcattgtaggcggtgcgcgtgcgtccataggcgaaggcgccggcatagcgcgggttgtgcaagatctggagcacgcgggaatggtcgatctcgttccacaggacgtcgcccttgccgatgccgcgacggatacgccgcggaaagaggatcttctcgccccgcaggcggcgcacgacggcgcaggccgagccggtctggcggaaagtatcgaacaggagccgcaccgtgtcctggatctgtcggtcgggatcgagcacgacccgcgcgtcaggggtgtagaccaacccgatcggcagcggcatctcgagttcgccgcggcgcgccttgttgagaatgccgccttgcagccgcgacttcaggatgtgcagttcggcctcgctcatcgtgcccttcaggccgagcagcatgcggtcgttgaaataggccggatcatagacgccgtcctcgtccatgatgagcgtgcgcgacaaggcggccagctcaaggagacggtgccagtcggcattgttgcgtgccaggcgcgacacttccagccccagcacgatccctgcatgtcccatcgccacttcgctcaccaggtgctggaagccgtcgcggtcctgcgactgcgcgccggagaggccgaggtcgctatcgatgacgtggacacgttcgatcggccagcccagcgccacggcgcgatcgcgcagggcgtattgccgcttggtgctctcggtgttctcgaacacctgacgaagcgaggactgacgcacgtagaggaatgcatcacgccgcagatggtcggcgtcaacctttatggcgatgtcagtagacatggttccctcgggtctctgctgccagcaccatgttggcgagcatgtgcacgagctggcgatcgtgcactgcgaccgaagccgtaggccgtgattccagccgccgatgcgtcggcgggggaggctgcgcgatcagcaccgccagcccttgccaaaggccgtggaaaacgatggcgcccatgtccttggcgcaggcctgaccgcaaaggacggcggtgcgcagcgtctcgtagaaatccttgcagctgcgcggtagcaccggggtgcgtgcatggggctcaccgtttttttttacgggcgatcgcgcgttcgatgctgcggggatggacactgatgccgagcgtcgaatgcagcagttctgccagggagcgcgcctgcagcggggcgcccgcatgctggttctgctcgatgagctgcatgacctcgtcggtgagtttgtgggccgactttggccctcgggtgcgcggcagcaggccggcaatgccgtcgcgttcgaacgcggcctcggcctgatagtaggttggccgcgacagaccgaaaagcgcggcggcatcggccttgttgacgccatcctcctggacgtgacgcagcatctcgtacttcacctgcacgagatcgagaggatcgaagaaggtggactcacgaaaccagggtgcacggacggcttcgggccgcgcattgagtgctccgagctcgcgcagtcgctcacgtttggtctcgttgggcatggcataacctcttcctagtggtgtaaatcaaattacgcctcgatagagaacgtgtcaacctaacgacgccgggcgatatggctgtttatgctgcatataactacaatgtagaggcaattatcgctgtgagcgcccgtatgattcggcataattagatttacataatcggcataaattgcctgacacgcattcagccgccatggctgcgctcgatttgctcgatcaatgcggctagggttgccagatcatctggacgcacgaacgacctaccggccgcgatctgaatgaaaacatcgggtgcagcgacgtccgtccatgacgcaagcagcgagcgaagccgcccatccgcgtcgtagaacatgacgcgatcctcgccccagttctgcttgcgtgtcgacaacacgaagcgctggccgcgccacggatggaacgggtgcgtgacctcgaactctatacgcacttgagtgtcagtacgaactgcagtcctggacttgaaagaaggggcgcgtcgagcgcgccaaccagacgctgcaggatcggcttgtcaaggaactgcggctgcgcggcatcgacacgatcgcggcggccaatgcctatgcgccggaattcatggccgacttcaatcgtcggtttggcaaggcgccgcgcaatccgaaggacatgcatcggccgtttgccgcgcatgagaacctcgatggcgccatgtgccgcaaggagatccgcaagctgtcgcagtcgctgacgctgcgctatgacaaggtgatgttcatcctcgatccgaccgacctcgccacggcgctcgccggcaagaaggtcattgtctgcgactatcccgacggtcgcctcgaggtcacccatgaggggacgtccctgccctacaggaccttcgacacgctgcgctcggtgcaccgctgcgaggtggttgagaacaagcgccttgatgacatgctggcgctggtcgccgagatgcaggccggacgagagcaacagcgcagcaagggcgggccgcgccgcaccggccagacggaccatatgttcggcattcgcgacggcagccagagcaatggctatcaaaagcgcggcaccaagcctggccggaagacggattttaccaaggatccggtggtcatcgccaagcggcagcaagcccttgcgcagctgaaagcggcggagtgatcggggtgtcaaagctgaagtttatcttgcggctggagccatccgccgccgaccggcctgcgcaaccctgaccagctccacccggccggcggctcgcgtctgcgtactttgtaaatatatcaacttgcaaacgcagtactaaggaataggatgatgtcgcgtttctaagttgattactttgtctcatctttaaatagctgtgacattttttgtagccgcaaagttaaagtgtcctgttcctgcaaagtaagaatgtcactctccccgcgttttgatggcgtgggagattgcggatgggattgattgcgatgagcgagcgcgacctgcagcggattgaggttttgtcgaaggtgatcgacggccgcatgacgatggtgtcggcggcgcatgtcctgggcttaagcacgcgccaggtgcgtcggctgctggatcggatcagcgctggcggtgcggcgtcgatccgccacaaggcgatcggtcgcccatcgaacaatcggatttgcgacggcgtgcgcgattatgccatggcgatcgtgcgcgagcgctatgcggatttcggtccgacgctggcggctgagaagctagcggagcttgatggcctgacggtgtcgcgcgagaccttgcgccaatggatggcggacgccggtctgtggctgtcgcgcaagcagcggcggacgtttcatcagccgcggttgcggcgcgaggcctatggcgaactggtgcagatcgacggttccgagcatcgctggttcgaggatcgcggtgacccctgttcattgctggtgttcatcgatgacgcgaccggcaagctgatgcagttgcgcttcgtacgatcggaaagcgcgtttacgtatttcgaggcgctggagctctatctgaaggcgcatggtgctccggtcgccttctattccgacaagcattcggtgttccgggtggcgaagaaggacgccaagggcggccagggcatgacccagttcgggcgtgcactttgcgagttaaacatcgagattctttgcgcaaactcgagccaagccaagggccgagtcgagcggatgaaccggacgctacaggaccggttgatcaaggatctgcgcctggagggcatctgcggcatggacgacggcaacgctttcctgcctcggttcatggagcgctataaccggcaattcgccattacccctgcccggtctgatgatctgcatcggccgctgaaccttgccccggatcggctgcgcgacgtcctgtgcaaacgtgagcagcgttatgtcggtgcgcagctgacgttttcgttcgagcgccagcggatcatgctcgaggagaacgaagtgacgcgcggactggtcggtcgctatgtcgagacccatgcctatgccgacggccggctcgatgtgcgctggaaggggcattccctgccctaccgggtgttcgacaaggaccagcgggtgacgcatgcggcgatcatcgagaacaagcggctttccgatgtgctggcctacatcaaggagcgccaggacgagcggccggcgccgaaggtcaggaccaacagcgagaagaacggctacacgccgcgcggtcgcaagccgggcaagcggacggatttcatgaacgatcccgtggtcatcgcccggcggcggcaggcgctctccaatcttgatgccgcggaatgatccattgatctggctgtcaaggctaaagccgataggtgcccctcacccgccccgatctcaccttgcaacccggaccagccggtcagatcggggctggtcgtcgcgccgggccgcagctcaaagtgatatttctactttgcgccacagcggacagttcaacctggccgccacattttttgagtgatttgagtgtagcacagaaggcgaacatcccccactacgcctgagccggagccttttcgtgtgcggctccccccgatccacacccatcattcaccgtttccggtcgcggctctcaagtgccggtcgtaaaggcatccacggccggctttcgtaatcgcccactcgaaatcagtcaggtggaagcgacggcgggtcacgcaaagccggcaagccaaggcctaattgaatcattatccgcccgccgacaaaactcccgtagtctgcgacctaatctgaaatggtcgtctccgagctcgtcggggggttcgcaaagcttcaacgatacaatacaatactaccatcgattgtgaggcggttatcttggcgagagagttgttattcttggcgtgcgcaattgtgattgccgacagctggccggcgaaggcgatcgacatagaaagcctgttcggacacaccatccgcattgagggcgagtaccctgaacgcaccttgaaagtcgatgatcgcgaattgcaccgcaacgcccttctcctcttcgacggcctgttcattgtggacggcgttccagcactgatcggcagcagctcgaatgggggcaacgcctgcgacggcacccctttcgtcgtttcgtttccacctggtgccaggccccgtttcgatggaccgatcgaagcctgtgcttacatcgggcacgaggtctccgacgagagaatcctattctccaccaataacattccgggacagggccgagagcaatgggcttggacgcctgccgacggaatgaaggaattaggcgtcgcagcatttgtccccgacgacaaatcgggttggcaggcgctcagggaacgctcgtttgagcatccttccgacgcccttaagaacgcggatatcgcggcaacaatcaagtcgctgctcggagctgatttcgaagcctttcaggcaatcatcaccggaacgggcagcggcgaatttaagagcgacgactatattggtagaacgtgcacgccccacatgtgcagagaacaggaagcgttgctcttcctgtctgccaaggatcgtcgcgcctatgccgcttggaagccgcaccaaaagaaaatcattgttcacccacctgtgaagcagtggcccgagaaagcaaaacaggaattgagagcatgggcagaaacgtggaagtaacagcgctagcggggctgatctccatacaatagtgccccagaaaccggtgacttacttaaatagtccctaaagcccaccagatgcgccaggttgtttctggggcgaatagtcaataatgcagtagtcatcgccgatttgcaaaaaaatgacgacattctgattggcgctatcccaccacttatcaattgatgtcactggcgttcttgaactctttggcgggccataggtgtttgaaagtttgcccgtcagcgaggggcaatcttgtccggacaacaatttcaatctcacgagcgcaagacccgagtttcggccaaaaacgaatgcggccttgaatttgaattggccggcagagtacttcccgtcaagcaagtgctgcagccgcctgtccccttttaaccgttccggtttttttggcttggtgattgaggcgtcatcaggcgcattttgacgacttcctttggcgtcatgccccatctggtatactgccaatccgcccatgcatgtgtgccagccgtagccatcaacatgagcatacctaaaccgcctgcatggaccaccttcatttcttgccccccagagcgcaaacagacacttttcattggcaaggagtaagcttggccgactccgcattcttcggaccatagcgagcaggaccacgcctactgagcttaagtatgcagggagagtcgttcataggcgattttctcattcgcaggccactccgtcgccatccctgtcgagcttgcgacggtagccgggctcgccagcgtaaataggcgctgcaccagcagcgcgtgccgcggcgcagttttgaaagtagacctcgccaccttcgggcgtggaattaccgtcatcgttcgtctgagccattgccggcagattgccaacaaggatcgcgaagagggcgacggccgtggtaagcaaacactctttcattcggtttctcctggtaccgagcggcgcgcaaaggtcggggtgacaagtctttgcgttgtccggtacaggattatacaaactgcaactgcgcgtatattcggccagatggcttagcccgctagggtaggccttacgggcgtcaaccgaggtgacgagctggggcagttggtcactgagcctcagaccgagcagccctcactgcgaggcgttgatcgcgcgacgggtatatttttcgtcactgcgtgagtccgggccgccggaactccgctcgcgcggtgtgccggccttggccaaagccgagactacacaattggaatcgaaccgcggacgccatgctgcgcgtttctggatttaccccgcactcaatgcttaaagcagttttcccggtgccagcggaggaagtgcggatgtggcctttcgaatagtcgctgcggaacgatcgcgcgtcccgttcggttgatgactggatgctctccgggtcgttcccctgccgcgaaacaaggatgtttagctcgtcggaaaggctggatcaaaccccgatcgaacatccagtgggcggtcccggaaagcgcaatgccattgctcaggatgtcgggaccgttggcttagaccaagcgaatatgcgcagcatcgacttcagcacgaccgccgccgttaatcagctttagtccggtgatcgcgcatcgcttgtcgtatgctttgaggacaaggcgacggaaaagacgattgcgaacgattcgagacgtgagctgagcgacacgatcacgctcctgctcaaaaacgaaggatgactgcagttgctcgcccattccgggtgccaaatcgacgatttctggctcgccgacctgcccgtgcgtttacgatcgaagcgcgaaatggtggagagggggcatgcactatcgctcgcaaaggaggtcggtgctgttcacggcacccggacttatcgtcggtgcgctcgcgataggcgctgcgggcggcatcagcgtaagtccgggcgacattcttgcgctcgtggaaaagcctcacctgctggtcgccgttctgttcgtcggcgccttcactggcatcatggttgagcaggctctgtcaaggatgcgaaggcaggatggcgcgcgaggaaccgctcgcgctgggagaaacagcgctcggcgacgaatgccgtcgtagggccatgggctcccacaagcgttccggaatcaccgaaacgacccgacgctaccgaacagctccggattgttatgaactccaccttcacgagtcagccgctcctcaacaggagcgaaccgcgggtattcaaggaattctatcgcctggtgattggctgcaatccggcttggcaggtgatggcccaagtctcgttaggcgaaatcctccgcagcaaagacgcggacgcgtacagctgcataaacgccaagcgggtcgacctcctgctggtggacggcaactgccgccctcgccatgtcgtcgaatatcagcgcggagcgcaccatcagggtgccgcagccgcgcgcgacgcggttaagaaggcggcgctcaggtgcgcagggatcggctattacgaagtcgttgccggccagaccactccgtctgacctcagacgattggtcgagaagctcgtggagaagccggaacttccaatatgcgctccggactgacggggggctcggccgcggctgttggcgctcagaagcgctctgcccctcgacacaactcagacgccgcagcgggcgaatagtccgcacgcccctgaccacattgcatactggttggatgctctcttcaaggttggggcttttcaatatgttcagactacttgcggcgatactcgttttcacgggactagcttcggcggtgaatgccgatcttctgcagactgggggtagccgatgggttgtgctcgcaagtacgcgagatctcgacaacgccattggcatcgcgaacctttaccagcatcgctttgatgacgttcgcgtggcggaggcctcgaacggttggctcgcagtgatcgcaggaccagtatcaatcgcccgaggagcgaaggcggcacgcgaagaattgtggagtgctggcgggtttccccctgacttgttccttagcaatgggcaaagcttgagacgcaccgtgtgggagccgccgaaaggtcggcccattcccacctggtcgtataaaggtggccagccactagtcttttcagctggagggctcgagattgaagtgtctcatcttgccgagggcaatactcggtatccgtctatcacgcttcgcagggccggacgtctgctcataaaggaagttctgaaggggtccgagtctttcggggacaacatgaatgctgaagtgcggctcgtttggctcgaccgcgcggtcgccgaaccacagatcatcttttcatctcattggaatggagcacattgctgcacagtttctaaaatactaacaaaggtcggcaacggctggacaagtatcgaaggcgctacgctcgatggcggtgggtatcgacttcaggacatcgacggcgatggcagcgtggaattgctcagcgtcgacaattccttcctttacacgtttgctccttacgtcttctcatcagctccgttggtaatatcgaaactcgatggagatcgtttgattgacatgcgctggaattctgccttccgacgctactatcgtcgcgagctctttggatgggagtaccgggcaaaactggaaccagagatctggcgaaagaacggttttctgagcgcttggctggcattgaaatcagtgttgggcgaatcagaccaagcctggaccgtggtcttggaaaattacgatcgttcaagcgaatggcccttgaccgtatgtgatgctcctctgaaggaaggtgtgtgcccagaggaagccactcgcgaggtgagtttcccggaggcgctgcgcgatcaccttgcgcgtaatggatacttgggtccgcaagtggcgaaaatcgaggaaacttcaaagcccactgagcagccgtcacccgccgatagcacatcaacgcctgcggcacctgagaagggcgccgcctccagtgcaggaacaggcttcttcatctcaaaacaaggccaccttgtcaccaatcaccatgtgatcaagggttgcagcgccatcgaagtgcgccgccccggccagttgaggcttccggcaaatattgtggcagtggaccccaccaatgatctagctctactacgtgtggaaagcgatacgggcgcatacgcatctgtccgggtagaaacacggctgggcgagtcagtcgccgtatttggctatccgctttctcatgtcttggccagcggaggcaacttcaccctcggcaatgttacggcgctggctggccttggcaacgatacgcgtttcatccagatatctgctcccgtccaaccgggtaatagtggcggcccgctaattgatagttatggcaatgtcatcggcgttgtgacgtcgaagctcgacgcactggctgcacttgcggtaacaggggacatcccccagaatgtaaatttcgccctacgcggagcaagcctgtatgctttcttgctctcctacgggatctcgcccgtggctgggtcgaatacacaaaaactggacgcgccggaactcgctgaacgtgcttcgtcattcagtgtggcagtcacctgtgaatgacttggcaccggtccgctgcgaacgtgttacgtgcagctctctcgcacatggccactaccactgcaacgtgcaagtcggagcatacctcgagctcgagctcttgatgggagtagaacctgagacttcgtcaattcgacgtctggcgcagttgaatggatccgaaccggcggcaccaagctgtaaaaacttaagtcattccgtgctcgagattttttccaaaaattggcttacgcgagatcttacatcgttacctcccaccacagtgatcgtcgcaacgccctcacgctggcgaagttgacgaacctgacgagatagcccatattttcgttggaggtgccctatggccatgaccgagaaaaaaggtggttcccgcaagcgcaacgagcgccgtaagaaccttatcaccggatatgccggcaaatgggaaccgctctttgagaaaaaagcggcggcccgcgcgaccgcagcgcgcgtgctttctggcgtatccgaaggtgtcaagcgcgccaagaacacgggcggcaccgttcgtgtgacctatgtcattcgatcggcggacgaagagccggaaatcgagatcgaagagatcgcccctcagaaggacgcgctggacaccgccctcgcggccgcaaagcagcgcggcgccgagcgtgtcgccgagatcctcaagggacccgagatgttgtctgcggacgagttcgccgaagagatcggcgccacgcgcgagacggtgaacagaaagcgtaagcgtcacgaaattctcgggctcgaaggagcaaagcgaggcgtgcgctttccgaaatggcaaatcggcgatgatggtcaactgcttggcggtctcgcgcaactgttcgaagctttgaacgggcacccttgggcggtttaccggtttcttcttcaggaaagcgatagcctcggcggtcgcacaggtcttgagatgctgcggaagggcatgatcgagcatgcagttggagcagcgcgctccatcggcagaggtgatttctcctgagcatctcgctgaatttgctgccgccggccgacttcggctcgcgtgagcttgtgacccaaaaattgacttcgaacgccccgtggtaccggctctaccaaagccggtatcccaaccctcttggctacggcttcggatcaagccgcttcagtgatcccgaagtgaccctgtctgcgggtttcggcaaagtccggacaggatttccggtaatctccggacacagttttcagtaattcccggacagcgattccgctaaatcccggacagtttccggcggcggtttgacgggttggttcgcggctgcgccgtcttgttggttaggcctctcacgacaacgttgagaggggccgatgccgagacggaagcaagcaagacgaacgacagtgagggatatccggactattctgcgcctgacccatgaagagggtctttcggtgcgcgagattgccgagcggctgaagatcggcaagagctcggtatcgacctatttgctgcgatctcgggaagccgggctttcgtggccgttgccaatcggcgcggacgaggatgcaaagctggagcggcggctgttcggccgagccggtcgaccgccgcgcgatctcagcgagccggactgggcgctggtggttcgggagctgaagcgcaaaggcgtgacgctgacgcttctatggcaggaataccgcgccagccatcctgatggttacggcttcacctggttctgcgagcaggttgccgcctttcggcagcgcaccagtgtagcgttccgcaatcggcacgcggcgggcgccgtgatgcagaccgactatgccgggccgacggtgccggtgatcgatccggcaaccggtgtcatccatccggcccaaatctttgtcgcggtgctgggcgcctccaacctgaccttcgcccatgccagctttagccagcagttgccggattggatcgacggtcaggtgcgtgctctgaccttctatggtggggtcaccaaggcaatcgtgtgcgacaacctcaaatcgggggtggccaaggccctttggttcgagccgacattgactgcgacgttcgccgccatggcggagcattacgacaccacgatcctgccgacccgcagcaggaaaccgcgcgacaaaggccgggtcgaaggcgcggtattgatcgtggaacgctggattctggcccggctcaggaaccgtaccttcttctcgcttgccgccctcaacacggcgattgccgaattgctcgaggacctgaacaaccggacgatgcgccatgtcggcaaaagccgccgcgagctgttcgaggagatcgagcggccagccttgaagcccttgccggcgataccgttcgaatatgcggaatggaagtcggcgaaggtccatccggactatcatgtcgaggtcgacaagaccttctactcggtgccgcatcggctgatcggatgcaccctccaggtgcggctcacccaccgggtggtcgagatcttccacgaccaccagcgtgtcgccagccatgttcgccgctcccagcgttccggccacgtcaccgtcaacgaccatatgcccaaggcgcatcagcgctatgccaacaccacgccggccaatctgatcggccgtgcgacccagatcggccccaatgccgccatcctggtcgaacgcatgatgcgcgacaggccgcatccggaacagggataccgctcggccatgggcattctgtcgctggcgccgcgctatggatcccagcgcctcgaggcggcctgtgagcgggcgctcaccattaatgccatcacctattcctccgtcgcctccatcctcaaatccggcctcgaccgggaaagaccgcaggctgaacacgcggcccccacgcctgcgcataccaatatccgtggccgatcctactaccagtgaaggaagcaagaatgctgacgaaccccaccctcgaccagatgcaggccctcgggctgacgggcatggccgccgcctggcgcgaattgaccgagcagtccggcaccaatgagctcagccgcgatgagtggctcggactgatgctcgaccgcgaagtcaccctgcgcgccgacaagcgcatccgtaaccggctcgcctccgccaagctacgctttgcccaggcctgtatcgaagatatcgacttcgccgccgcccgcggtctcgaccggcgcaacaccatggcgctcgcccaggggcaatggctcaccgcccacgagggcctgatcatcaccggccacaccggcaccggcaagtcatggctggcctgtgccttcggcaggcaagcggccaggctcggtcactccgtgctctatgtgcgcgtgccccgaatgttcgaggagctcgcgcttgcccgcctcgacggctccttcccccgcctcatcgacaggctcacccgcgtccagctcctcatcctcgatgactttggaacccatacgctctccgatcagcagcgctttcacctcttcgaaatcgtcgaggagcgttatcagcgaaagtccaccctgatcacagctcaggttcccgtggcaagctggcacgaccttattgccgacagcacggtcgccgacgccatactcgaccgtatcgtccacaatgctcaccgcatcaccctccggggcgagagcatgcgaaagcaaaaaagcgcacccctcttgactggggcagaaaacggcgaaatcaatcagccctgatgctaaccaggctgccgaggaccaaccgcatcaaactgtccggactttaatgaaattgctgtccgggatttagcggaatcaatgtccagtttttgcgaagcgcgcaattgccggcagcatcgccgttccccaagatctaggcacggccgatttgtgggggcatggaacacgcgttgccggcattgccgccttcggcgatctgcgggcacaattggcgactggagaactacgtcgaggttccaggatctgtgcggccaaggtcacaaacgatacaggcggctttgacgaccggcgcctcgtgccttcacaaatgcgcgaagcaatcactcggcttaacgaagaattcggttgcaggatttttgtcatctcgctcggcgacaagaagcgcgttttcgacggtggcaaggtcgggacttgggccgcgacgctcgacgaactcgcgcgagagcgcaatgttgtcattatcgtgtccgctggaaaccgcgggccacgcgccggtagccgcgtggagcaaggcgtcaccgagtatccggactacctcctcgaggcaaataatcgcctgcttgagcctgccggcgccatgaatgtaatcacggtcggttcgattgcgcagggagacggtctcgacgccgatatggcgggcgatgtgcgggtccgcccgataacccgcgcgaacgaaccttctccgttttcgcgcgtggggccaggtctcggtggtggcaccaaacccgatcttgtcgacgttggtggcacgttgatcttcgaccctgtcgtcgcccgccttcgaggcggcgaggatcggccgagcgctggggttctcaccctcaaccacaactatctcaaccgtcttttcacggctgggtccggcacatcctactcggcgccacgcgtcgggttcagcgccggtcaaattctcgctcgctttcctggcgcttcagcgaacttggttcgtgcacttttgatcaattctgcagaggtcccgcagcaggcaagcgagcgccttcagatactgggaagcgaggcggtgcgttcggtttgcggccacggtctcatcgaccttgagcgcgccggtttttctgatgatgcccgtgtgacattgtatacggaagacgagcttccgctcgatcatttcgctgtctatcgcatcccaatccctgaggtctttcaggaaggaaacaccgagcgcacaattcgcgtaacgctcgcctatgaccctcccgtccgccatacccggaacgactatgctggcgtcgggatgagctttcggctggtgcgcgggtgcgagcctaatttcatcttcgagcactatcgcaagagagcggaggttgaaggccccttccccgaaatggagaaccgctttaactgcaaactcgagcctggaccgaaggtaagagagaagagctcagtgcaacgcgccagcatcacgttcaagcgcggaatcgagcaatacggcgacagctactacctcgtcgtgcgctgcgagagtggttgggcgacccatgtggatcggcaaccgtttgcggttgtcgtagagctgcttcagaaggctgaagtccggttatacgaacgcctgcgtcagcgcgttcgggcataacagaacatctgaaccagtagactcctatgcggccctctcaccagtcatgcccaacggagtatggaacgtcaaatgtctcaatctatacaaattaaccgctctgccgctgacgcatggtcgcagctggtcaaaggcggagccctcgacattgatggccgcgacaaagagttcgccggggcgatctgcaagatgctggacccgacgggaactgatctcggggacgcgctcgcgaaagcgacgacagatcagctaatccaggtgttctttcgtgccctccagcctttctcagaaatgtaccgtgaaatcctacggtttttcacaacagccggcgcaaaatacgggcgggaccaatggcggattgggattagcgaaaagcacttcgagctgtctgactttgaagatttcgtgcggatgtgggacggcgttcccggtgaaatcgatgttccggcattgggacatgaagactttggcattgtttggcttgcctgggaagcgtatccgcaactaggaaacgtcgccaataaggcggcgcgagaacctgccgagctcggaattgccgacgtcgatcggtggctcgtcgactaccgatcgggccaaatcaaccccctcccactatcggtgctatcagaacaacaggacgcaggtttccgagaattggccgcactggtcgccacagttcatgagggattggtggcgtttagtcagaaccgagctgtgttgcggtcgcaattcgattggcgaacgttgaagggcagtgatgctttttcagtcaaccaacttgccttcctcgatacggacaactggctggggacagctgtcgcaggcctggcgctggcaaaggggatcgcccctgaaagcagaagcagaatcgcccgcgttctccaaaatgcgttcgagggtctgccaactcgcaagctgaaagcgagagtctccttgaacgatctcgaccggtttttgtcattgccggtttggcagaagcgccacgagatctatgcggtctgggtattcacagaattagctgcggccgcgaatgagcacgacctggagatatatcacgaccaaggtaggatcgccttcgagttccgggagtctcgacttgccactgtcacgtcggcacggccaccaatcgatatgataacggagcgtcgctctccaattgcaaatccagtcggcgctggtcgaaccgccaatgtccagccagatttcggactttgggcacgcgatccgggggccgagcgctgcgctctggtggtcgaggtgaagcactataaacgcaccgcgaagaagtcgttttcggaagtcatgaccgactatgcggctgctcatccgaatgcgccgatcgttctggtcaactacggtccgatcggcgacattctggactgcatcccgctcagcgcgaaggctcgttgcgccaccgtcgagcacctgactgccctcaaccggacagccagggaggaatttcgagacttggttcgaaaggtgattggatggccagtgcgggcggcgcccgagatcggagggacaacccgggcgaaaagtgctgtcgcggtcgatgtctcgcgttccatggctccagtcctgagcgatcctcgattcagctccgcgctggccgcgattgcggtggcgccgcacgcctctgaaatctttcccatcgatcgacgtgtccacaccgcaatttcggtcgagcaggcgatcgagcggctgcgtagcatccaaggcgacataaacgcgttggaagctccggttactgagctgcttgggacttatgacgaagtgatcgttttgacggatcgggatgggcttaacgatttgagcgcattaagatcggcaagtgaggaatttgccgcaggtagctttttccgggtgactgtcagcaggcctgagtcgacgtgatcggccgaggctcgccgccaaccgattagactacccatcacagcattgcccccggcagaaatgccgggggcaatgtttgaattcttcccgtcgggagccgaaagatggctcaatgactgactgctaaaagccgcagcttatgcatcctgcgatcaacggccagagccgggttagccgcagcgacagcatccaaaatggcggcgatatccgatgtgcggcccttgcacggcggcccgcatgcggcccacaccagcctgagggcggcgaccgggaagcgcgtggcgagctcggcattgttacgttcgagatcgtgaaggctgagccagtcatcctcgaatgtcgagacatatggtagaagggcttcgaccgcagcttcaaacgcagtgccggccgccgttgctaacgaaaatacttccttgctcacgtcatttgaaagatagctgcggtcgcgcggccagatcgcctggaatgttgggccatataggtcagtccaggcggccgctcgctcgtcgtccggattttcctcaagccagtttgtcataattttcaaggcaccgacgcgtatgtccgcggcagcctcccgaagcgtctgccgcgcctgctgcggcgagatacccctgaccacattcggttcgtcaaaagacgcaaccaccgctcggacgagatgcgaggctgcattggcggccgagacatctttttgccggctctcccgaactccctgtagaatgagatcggcaaagctgatttcagtatccgcaacgaagctgttgtattcgaccaagaccccgcgtagtcgcctcccctcatcattgtccgcagcgatgaagggtctcaagtggtcgagagcaatttcgttcgaaacgctgaaaacgaatgacaggtaccggacgcacgctgcacgtgccatttcgccggaataggtcatggacacgatcatccgctgcaatcgttgaaagtccgcggcgttcacgtcgtctccattttccctttgagagctgatagcttgaagcagtgcttccgcaagtgatccaccagtcgagttgatgacccggtcataggtctcgacatcatccccccaatcaacgtcgggctcgccctcagcagcttgccacagccgatcccaccagttcgcgggaagagcgagttgaagctgccgtgagtgttctgctatgcgagccaggggaccgacaagagcgatgacgatctcgtcatctgcctctccgagaagctcgaccgcttcttgaatgacacgcagccactctgggcttgtcatattcgcacgactgggaatgatctctagccacgtcgcccaacgtgcaactacgccgatttcaaggggatgagaacgcagcgcagcataggctccgaccggatcctctcgacaatattccacccagccctctcgatcttcgatgtcgctgctttcctcgagccgatcggcgatcgtgaggcgttcgcttggttgagccgacacaatttgcgcggtgcgcccgcggacggccctgactccggagctccaagtgcggaaaagatcccgctcatcgatttcacgcgacaggtatgtgcgccgctcacgaatttcgtgtagcagggtttcggcctcctgcgggagaactacgtgctcactgatcgcggtcaatcgaacccaaatatcgcggtcacgtgcacggtcctgccagtcgataccgtcagcgttctgttcccggtcggcatatctttgtggaccctcgacaaggaggcgccgaactagacgttcgaccgcctctccgcttgcctgagcaatgcgagcgcgaacaatggcgacgaactccagcgcgaaggaccagaaggccgcctcgttgctggttgccagcgcctcaatagcctcgtcggcggtgaaaagagcttgatgtgtaagtgcgtgcatccaaagccgggtggtcaggttgaacggctccgcccgccatccgccgaccacccttttcgtcccctccaaattggcttgagcggccatgggcaacgcggatgtgataaatacggtgagcggaacaaacccgcggcgatgctgattttgctgatgattaacaacggacggtacaccgaaatctgtaacatcgcgtacctgcccgatcagttcagcatcgcgcgcagtccggagctggcaagaaagtcgctgcgaaccccgctcgagcagccgcaggatgttttccgcgttgccggcgggggacgccaaaacatcccgcaagaactcctgatgctcgctctccatcgaaaaacgagcaatatccgagagctggtttgggtgctcagaaggatcctcatcgcgaaacggcgcctcgattgtcaggcgcggtccgatggcattgaccaagtgtccgaggtcggactccacgaccggccctcggttcagccggtgacgcagctgatagtctcgcaaactgtcgtgtgatgccgccgcggccgcttcggcgagcaagcgccaggctttctcccatatcgcatcctgcggacggttctgatcgagttcgcgaaacacggcatcggagaactcctgtgatcccctccccagatgtttaatggcggttaggtatctgaccttgtcatcccatcctcttgcgaaccatcgggcaagcatccaggctcgcgcgcgttcgccgaaagctcggatcaccacggcaagtgtgtcgaaccatgcagcatcttcgcatcgcgtaatgaagtgctcgaaaaggtcggccctcgcgcccagcgcccatttgagggtgcgaatatcgtggtctgtagtttcggataccgggcccgagacgatggcggcgatcatctcgcgacgacgaacatctggattctccacgaggttggccaggccttcaagacttgaccatagtggcccgtatggattgccgccttctggatcgaataggagcggctccaccgccagagcctgccacggggcggccgcggcttgggggtcgccatttgatgagctgagcgcatatacgcgcctgagatcggtaaaacgctccctgtcaccttccagaacgttcaggatgtagcgcaccggagcatcgttcgcagtatagcccaccaaaaccaaggtgcgacaacgcatgaggtcgaaaaggaagcgagcggcccagccggctcgcagatatgcctccccatactgagcgctggtcagtaccagttctgtttgggaaagattgagctcatcgtcggtcagccggccgtgggtgtggacaactcccgtgaacctcgcgctccctggagcgggtatatcctgtcctgccgcgctctcctgcgtcgcgaaagctgccgaatgcgaaaccatgagtgagcgctcgaacagcgtgtcaaagttcgtggtgacgataatcggccttccaacctgatcacgtgatagccgcaggatgacgtcgtgatgcgcggtatcaggatttgcgggaacctgcagttctgcggccgcagcgtctataacatcctctgatcgtacaaggcgccgtgacagggcacccaaaacttcttcatagcgagacgcctggaaagcatggtcttcggcaggcgtgcgctcttcccccaatcgattatagacgttgagcacgaggtcgcgaaaatttggcagttgcggcgcgctgacccctgcaccgcagagaaatacgacattcccttcgagcagttcgtcgacgagcgcttccgggaaatcaggaccgaggtgatgaagtctcatggcactctgacaagctcttccaagttgaatactgcgctgcgtcgcatgcgccgacgctaaaccaatgcatgaaacatgtcttggagaattggaagcgcgattgcggttccctgacaagcggccgcgagagcggcggcttttgcggctcgattgttcagcgcattggcggcgttctgcgtcttgaagacatcaatatcgccctttgggccggaggctaggatagccgcgggtctccatccgtcttccgggatctcgtgatcgaatggtacggcaattaccgttgaccgccaccataatccagcagcggtgaacgctgccattgctgagagcgcgtttaataaggtgactatcattttgcagtctcgcagcttcgggatccactgggcctatatgtagaacttaaacggctgtttcttctcgcctttgatcgccgatcccatcgtcaggacatcgccgaccattcgagcgaaccgcacggtgaccggaaggccatcgttgaagttgcaagaattgtagttgatcttggtcaggcccatgatgtcggacagcacgtcacgaatctcgggcttggcatccttgctccgcgtcacggtgacatgtagcggatttggggtttccgggccgatataggtatcaagctgcggaacgtatccggtcgtccaaatgtaggctgtctgcgcatcgaggatcaaggctgtgccgcgcaacacaggatagtctccatcgcggaagagcttcatttcgccaccggttgggcgaatccgcacgccaacgacatttgtccccttcggcgccgcatcggcaaacgcggcccattcctcatcgttgaagtaggtctgaccatggatgaagagctccttaggcgcctcgccgtgggtatcgacatagctatcaagaacgagcttcaggaggtctttggctgcgggagccttcaaatgatagtcgtagtccccggtcttccaggggccgtttgcaccacggaaaacgacaccgtcgccctcgttcagaaacatttgcgccgcgcagcacgcgtggccatcgggatcattgggcaggctcttgtagaccatgccgaggtagcaaacgccaggccggatcgtcgataaccgccacggtgggcgcggctgtgtcttatagtacagaccagtgccgagattccaggcaaccgtggcacgatcctgcgtcttgcgggtcgggtaacctgccgtattgagaaacgcgcctggcgcaagcgtggtttctcgaatgagctgcgtcggcgcgatgttcaagaaatcggctttgatgcgccgatgaaaatccggaacgtcgtcaaaaatggtctcaccactttgatcgataatacctgccaagagcggcaggctttcgcgcttcttctgcttcttggcgaaatcccctttctccgttggcagaccagtgcgcttagaatttggtcggcacctttcatagacgatctcaggaagcaccagcacccagatgtctaccgcgcgctcctcgttgtggagatgtttgtttacacgctcgatatagagcttcgcgaccttgtccactgcttcgtgctggtttgtcacccgcgtcgcgcgatcgatatccgcgagcgggatcgataatgcgctgagctcgtctgggtcgtaggaaattccaaaggtctcttccaatcccgggaagttcgcgaggtgcagccggttcgccttttctcccttcccgggcgggggcaccttgacaatggattgtagctcgcggctccacgtccggaagtgaccgatgccttcacttgtgccgatgacaccgacgcggatttctttcgcctttttccccttgagatggggtccgtaaaggtggaggccgtcctttgggtgcgcgctcttctgaccgaaggcaaactcaagttccggctcatggatatgatcgacctcaagcgatcgttccagaaatttcattcgccgccctcctcatcactgtcaggccgcccgagagtgctgtcatccagctcctcgtcctcgtcatctaggtcgtttggaagaacggtactgaccggcgatgaaaacagcatcggcgatgcctcgataacgaaggtttccgtctcggaaagagggaggcgaacaaaagccgattctccggaaagcaattctagaaacgccagaagccgcccgtaccactgcttgttgcgccagcccttacagaccgatcgcctcaagcggtgtagcttcttgggatcgtcgacaacaaggccggctggggtgtcgttatcttgcgcaaacaggaccctcgacttcagcttgaagtgccagaacggccagaaagctggcatggcagtcacaccgaattgccagatatggcccttagcggaattgcgcagcatcgatgaccgcttcttctcggcctggttcccccacggaattcgcttgcccgtcggcgcctgttctggtgacgcgtggaagccgatgccattcgaatatccgtgttcgatgaacccgttgcgtttgcagtagttgaaccaggccttcttgagcatcgctacaacgaggttggaggcaatctggcggtcaattcgcagtcgctgaaagccgccctccgtgaattccacgagcggaatttcatgtttcagcttgaagcggccgacggcttcgaatgccatttcgatttccggcacaccaccgaatgccagaaaacctgatcccccgaccaatgcgcaaggatgtccatagctgtcgatcgctccctggaggcgccctttgttgatcgatccagagcattcgaagtatcggatgaaatctggcgcctcggcgacccgaagccagtttgaggtcagtcgctcaggaacttcgatgatcggcacggcgccgcgccggcgatagatctcccagttggggtttatcatcgtgtcgatgctgcgctggactttttgccgttgcagggtatcgatgagcttgagcaggccttctccccaatttcgaacgaaatcgaccgcgacagtgtcaccgagacctttgatcttccgaaacgtctccatgcgcagcggaatgacaaaccgctgatcaccgagttcctttcccgtttctagagcaatgtcgaggtcgtcctggatgctgctatcctcaagactggaatcacggcagagaagcaggaccttgaccgcgcgatggcgcagcgcactggttatctcccttcgccaacgttcgccaggcatgagggtgagcacgtcggcaaagacctggtagccctcggcctcaagctttggagcaagccatagcgtgaactcgtcgtcgatgggtgaagccttgattatgaagatcgtatcgcgctttacgggctcgatcggagcatcggctgccccgggtggcggcatcaggcgagcgagcgttttgggaacctccgccggcgccattgccttgcgcaccgcgttggtgacgacctcttcgagcactggggtgctgtgtgcccagagcccttcatgagccttcacaatctcaggataggatctgagcaagccgttgaggtcgtccgcgccaaatatgtcgccgggtccgactaggcttggtccaatgatttccgtcagcgttgccttgtttgccggggtaagcggtacggacgtcgtcagaatgtatcgttgcggggccagttcgtcgattgaaacacgttcttctcgcatcttcgacttgagtttcgagaagccagatcggagatagtgcttggcctggaggatgatcgaaccatcggctttggcgtggcgtccatccataccgtcatctgcgccaacggtgaacgcttcgaatcgaactccggtttcggcgcccacaagatcgcgactcaggttctcgaagtcatccggagaaagtgttgagaaatcatacttcatttgtcggatgatgggtcgcgacaatactaggcgtcaaggcatcaatagatgtcttctcagttgtagtgcggttaccaacaactctgatcgcgtgaaagcgctgactgcagtcccgtttcgccagagtcgccctccgctgagcccctcgtgaaaccgaataccccagcactcgagaaatccggaagcccgctcggttctcaactacgaggacggatcggtaggtaagggccccacctgttccaaggtagcagagactgccgcgctgtagctgggtttggcggtgacaaaatctcgaagcgaataccgctccgtagaacggctactgcgcaccaagccatcctcttcgacccaatcaaaggccgagataaacgcatgcaggccgttcgcccgctcgtaccgagcatcatctcctcgcctctatccgcacgctaccccgtcccgcgtgccgccaaccctatcacgcgaaaagcacctcggtgaggttctccggcggcgaccagaggccagccttggccttaacgtaggtttggcaaaacgtgacgatcttctcctgatcgccaaatttcagcttatgcttggcaatagtcgtgagctgttcgaacgcattcgacgtgaaaccgtatgtcgacaggaagaggccaccatctttcttttcttcgacgatgatcttcaagagcttttccacggccgccgatcccaccttcgtggatgaacgccaatgtttgatctctacgtaatactcagcgagcttacccctcaccgtgcacgtcagaatgacatcctttccaccatccttcgaccccggcgtaagcgtcacggcaaaacccaacccttcgaacacctctgcgacgacctgctcgaccatgcgccattcgagatgatccagggcatccggacttttcgcgatcaatcgcgctagcccgctgcttagatcccgcagcatgatccgaacctcagcctccacatcgaccttctcttcgcgcaggcgactgatccaggcacgcattccgccaatgtcgagcaattcgatcctaagcggcaagcttttctccactgcggcatgcgcctcccgcggaaattcgccgttgctcaccagcacgacgcgagtgagatcctgcaacaatgcagcgccgatcaacttctgcagatctgccatccccacgcggctaacagtcttcctgtaaaacttggcctgaactccgatggtctcggcgggtgcagaactggtctcatccgccgtacgcgaggcgcggaaatcgattccctgatcgttcaatccgccagtatgctcaacctcgtagccttcgatcccgaaaagcggctccaacacgcggcccaggaccaattccgactcttggggatcgaggctctcgttcgcccgcaatttattgagctcgagatcgagtgcatcgcactccgctgcacttagttttcccaacaaccgccccaaccgcgtgctccttccaatattcccatacctaattaccaaacggatttggtgatacccgtagagcctgacttgagggttgagaaagccgaatttgaaagtgttggtgtcaattttaacaacatgtcgcttccgcccagcaaaggtgggacatgcacgcttggcaccaggatctcgtagacccactaccgccgaaaaaaggggcgtgggcttatatcaccccccacgcccgaaacctccccctccccgtcatctctctcaaccccagctccgtcacgatccgccgcgccgcctgtggggtgacctcgagcgtcttggacaccatcccggccgaaacgagcggttttgccatcacaagttcgaccagctctggcagttttgacgaggtccgccgtccgtccagctttcggtccatcatcgttttcgccagcgtcagccgatcatgttctttcatgccgatctcagcagccgccagcaaaccgtgggcgatggcaagcagccgggtctcccggccgcgatggcggcgccgatcgacgggtatggttttcagaccgagattgatggcggcaagatgggcgccggtggtgatgccggcttcccgcaggattgaggcgcaaagcagccggccgagccagggcgcgtgctgcaggacagacagttcgttccaggcatcaagggcgacgatcgcctgcagcaccgccggcaagtcttgagcctggcgcagcacgctgcgccattccaccagccgggcgtcctcatcccaatcgaggtcgtagaccagtggatccttctcggcagcccagctgttcgcgccggcacggccgggtcgccttgcgtcttcgatcgcggcctccgaacgtgccagcaccgcatcgatggcggcataatcgacgccgggcagatctttggcgtcgttaccatcgtccccctccccttccggatcgatagcgaccgcgggccgaatgacgtcggccggctccaccgcctcgacgccgaccgggttgatgtccgacgtctgtcgcaaagttcggataccctctgtcgataacggccaatctggcgactgcgcagcgatgcgccggcgggtccgcaagacgtcgcgggcgattgtcagttcgtgggttggggtgcggatgtcgcgggtagcgtcgtggaggacgaggtcttcgagatggacgagttcgccgtcgatccagagggaggcgcaggcgtcgaggaaatgcatgcgctcaatccacccgcttccgaccggtgagcgggcgatgcgctcgtcgagacgcgtgaaaccgatgccggcctcgaaagccggccgcatcagggctgtcgtgctgattttcgccagatcataagccattgaaattatggtaaacaattttctaaaggaactctagtgcaatattactgttcctcacatcgtacgctttcgggttgcttctaaccatcgataggtttccagtatcgatagttatggatttggcgttgcaaatcacctacgtcggtcgtaccagatcggggattcgcctggaaacccgggcttttcagccccttcctcaccctctttcagcgaactcattcccctgatcgagtgaactggacctctgccgagcggccgaccgcggagccgtcctccggctatttcatcatcccggcctgtcagaaatgcaacggtggtacccgatcccatgcgtaacaggggatttcatcgcatttcggccacagaaggccgctggcgcgatttcccgaacttcgacggtccgagacctgttgcagaccagattccgcgctgtacggccttccattttgaacataaaacacgcttgcaaaggagccttttctcacacatgtttcatttgtacaaaccgccccgaaacgaccgaaaaattcgatggcaacggctgcatacctcaattctccttccctgcagcaaaggctgatcggatacgcccgtgtttcgaccgaggatcagctcaacgacgctcaggtcgacgaattgcgggcggctggttgccaccgcatccaccaggagcacggatccggcgcatcacgcgcgcggccggtgcttgcgaagcttcttaaagaccttgccatgggcgatgtcctcgtcgtcgttcgcctcgaccgtctggcccgatcggtcagccacctgctcgacgtcatcgaagacctcgagaagcgcggcgtccatttccgctcgctgcgtgatccgatcgatacctcgacgccgcacggaatgttttccctgcaggtgctcggcgccgtcgcccagctcgagcgcgcgctgatcgcggagcggaccaagtccggtatgcaggccgccaaggcgcgcggccggcttgccggcaatcccgggcttcgagaacgccggccagaagccatccgtgcggtctcagcggcgcgcgagcgggcctacctcgatgaactgattgtgtcagcgcagacctggctgccgacagtccggcgactgcgcccgcgacacagttgggacaatgtcgtgcggatcctcaatcgcagggggcacgactggaccgtcgaacggttgcggcgggcggtccaccggctagtgcgcgaaaagctcgcggaaccggaactgcttgcccgatcgctgcgccggccgcccgaggatcatctgatgcggctggttgccgggatcgccatcgccgatcccaatctgtcgctgcgcgacattgccgcccagttggaccagatgcaggagcgaccgccacgtggcggccgcaaatggcaaccgtcttccgtccgagcactactggacgaggcgagtcgcatcgggctggttcgcgcttgagaggcttggttcatgaattcaagagtgttcacgcggcgtcgaaagacgggtgcggcactgtttccggtcgccgcatgcttccaaatggaaaaagaccgagcaacccccgggctattccagaaagctcgcgttgtgaggaaggggccgcctaggcctgcaaattgtcagccgacatcttgccggacttacgatcctttaccagctcgtaactgatcttctgcccatccttcagctcccgcaggccagcccgctccaccgctgaaatgtggacgaagacatcggcgctcccgtcgtccggctgaataaaaccaaagcccttcgtcgcgttgaaccattttaccgttccggtcgccatcatgccttccttcgatcatttgccgtacccgccacagggcgggcgaggctcgcttcgtatacgcgcgcacagatagacgcttctccgctccgggtaaagcagcccgaacgttgacgcaactgcccagcccaagcaagcgatcttcgtcgccatagacgctactttttgcctctttgtttcagccgcgatgctgacgggagcatcctctgcttgccacacgtcgaactgatttgtcgtacagataagatcactgagttttcggaacccaagcgtgcacgggtcgaagtccggcgccaggtgagacctccatttgccgcagagcctcatccgaggcgcgctttccgcagagccccgcaaggttggctctggcggctgaactcgtcgtcgcgagtcgtgggctaggtgcctgagtcgccctcgatgccgacgcgcgacacggcgatgctcgcgctgactgcctttctctaggcaacggtgatccccgcgctcaccggcgcggttacgccgggcccggccgacctcgatgcgctcgccctgaacgtgttcgattgaatgaggaacccgttcgaggatcatgctcccgcgccacctgatctgccccacgtacagatcagtctgcccgttcgagtaccgctagacgctcgcggtaagatggtttctactgccgaagcaggaagttggcgcgctccatcagccagtacagcgcttcctccgagacttcaaaatggcaagggaacatttcgacaggcaacacagcagagcccaacggttgcttgagcttagccgtgtggcaatctcccgcgactgggacaaacacgcggcgttcctgcccccgtgccgttgagggcgcttatcccactctgctactaaccctgacgaaccacggccctcccctcgcatagcctgacgttcctgcgcgacttggccgaacaccgggacagcggctcgtcgaagcttggccgcgcgaactttctcgcaccgcgcgcgatcagctgcgaccggcgtcgatatgaccgtgtcccacttcaaccggtcggaggccttgttcgagtattgcggctcagcgagcttgccgtcgctgacgaggacgagaattccgaagtccgaggaccgcccaacgttgtgtggggatcgactacagcgtcgcaggcatagaagccgaacataatggtcttcagggtccgccgcgcttcttgaaagcagtggagctgccttcgagcgcatctaatcgtgtgagcgcgggaacgtacgggaaagcccgtcgccgaggctgctcggggcacgctggcaaggggcacgaccctgttcgtcgtcgagtttcgttgcttcgcctgccttcgtggcagcgtcttagcctgcgttccagtcgctgttgtgggtagggattttcctccttgcacatcccgatctccgccgtggtgaggccttcatggaaggccgacagtaccgttgccatcgctgcccccgaacttcgttacggccctcgtcaacccgccggactgtaccaaattggcgaagcgtaagcgcgctgcgtcaatcgaactcaggaccccttcccgcctctgattttaattgagcaggaacatacggtagaacatcgaatagcgaacgaaggtcccaggaccaccgcggccggtcaatcagagcgccacacgttgatgtctcaccgaccaggaacaggtccgtgccaaccgacgaagcctcccctgccccaccctgcgtttcaatccgcctcgaccgcaccaaaacgacgacgagcgatgatgacgaacatgtgctcttgatctgccggccggcgatcgccttgaaacgctggctcatggaaggccggaaccaacagcgcggtggtgttccgcatctaccacatgaagcaaatatcgaccggcgagcgctaccagccgcatgaaatacgcttagccaagcgataactaatgctctgttggaagtgtgacagtcattctggcagaatgacgaaacgcggtcacctacggactggctaaactttacgactcgcgtcctacaaacaggcgatcaacgcctcgaaagttcgaccgaacccctcccttcaacagcaaacgaagacagtttagaactaacgctctgattaatttgcgcaaatttccgtttttgtcagctgacaactttttacagtctgttttaaggaagcaatagtctcccctgcctttgcaaccaactaaaaatcaagatctggtgtagcatttggcctttcacagcatcgtcctggcgctcaagaaacatctctggtctgatgctcgaatgcctccgccaacttctcggacaccatgctgagggagctgcggactggtcgggcttgtccctgcctttggtgtcgtccatattgccatcgaatgtccctgcctgcactgtcctcgtaccgacgtggacgattggagttgctccccctactgagacaccataaacgaaagcgtcataacttctcctaatcggttgactcaacgtcccaatctgccgattttgtcagccgacaacaagcggtcgcccaagagctgaggggattggttcccgccgattaagcgggttcttcggtcaggaggccaatcgatcacttccgccgcgcgccctcagcagtgccatcaacactggccccggcgaaaactcgccccgctttgcccgagacgttaggtcgcggagatatccgccgggcgatttgatgtgccctgaccgctccagaatgcaggccatgacagcggatgcgttctcgggccccataacctcacaggcatcctggtaggccgacggactgacgcagagcatcgagcggacgaccactgcggcctgcatcaggtcacgcgggctcgcaactacgcctccggggccataatctgagatgcttgggcaagcccgcaacaccatccccaacggaaacaccttcatcggctcgcgttgcggttcgatggctgggctcggcctttcgccctgctcttctcgagagctaggttcaaattcattagtggattcgggatgtgaattctgtttgtgccgctcaatttgatcaggattgccgctcaaattttcgatttttaacctgatttccagaaggttggagatttcctcgcgcaacatctccatctcttcgaggatgggggcgacggtcgcggccgttgccactcgaggaatggtcgctactaggctgcggtagtgctggtgaattccgtcccaattaccgtccactccctcctcaatggcgacttcaatcagcttaccgatatcgcgccggcagatcgtcaggcgctcgcgaagtctacgcaattgcagtcgctcaattttgacataggcagctatttgctcgatctcgcgtgcgcgtgacagcaacggagccaacgaaaacccataggcctcatcgatcgaaccgtctccgtccttgcgggcgtagcgtttgccatttgggctatcccggcgtgccagaaggccagcgtcgacgagcgctgcgatgtggcgacgcaacgtcgcttcagccatgccatgcgcacgaagcgacaactgcatgttagaggggaacacgatgaggccgttttcctcagacaaggtcgtctcgggataaaagctcaaaagtgcgttcataacagagagcgcacgttcgctgatgccgagcttcggcttagcttcgcagagcgctcgaaacagcttccacttgtcagccgatgtttcaggttcgagttcacgcgacatatattggcttgccaacatgccaagcgtcatcgaccgccgcccgaagggcgtcgtcacacttccatcttgcatcttctttcacctatcctcaggcaaaagacgtccgctcacccgttccggtgccaaagactcttgactgcgattcgtggaaatgcgattctcaggctgctaaacgatgagagaggcttccacgatggttaccgtctgggggcctttttcttttgcgtcagtcttccttccgattaccctgctccaggaactcggcatagagccggtccaggttgtctgcaatataccgcccaaaggggccggcattccttgatttcatagacaaggcaaacgccttggcggagttcgaatacttagcggagacggtcttgtccgccggttgccagttctccaggatctttggagtcgtcttccggacaggcttcgccgcgctgttcagaccagaaaacagggaattgaagcgatcgtcagtgctcagttcattgaaggaaggatcagagacgattgccttcaccttcgcttcgttggcggttttacccacaagcaatgacaactcgacccagcgttctcggccgaccgccgggcagggcccgattcttgcgattgtctcttcaggaatacgatctattacggcgatcattttcgagatagcggccgcattggcagcaagcgccgatcctatgattgtccggtcatagccaagcttctcgaggtgcgaggcgaagttcgcccgttcaatgaaggagaggttggcgcgcgccgagttttcctgtccctgggcgataacgtgcgtgcggtcatccagcgccttgacgaccgccttaaccttgcggccgagctcgcgggcaacgcgggctcggcggtgtccaaagacgatctggtaacgatcggctgccgacgggtgggggcgcacaaggatgggcgtatcctgcccgcgctcggcaatcgcctgcttcaattcctcgaactgctcggaactatcgcccatgcgatcagagacgaacgaaccatcgagtgtctcagggtcgagttcgacgaccgtttctccttcgagaaatttctcggcctggcgcgacaactcgtcgagcgagcgcaccatgctcttcgaagccccgcgcatcgggtaggcgggcgcaacgtctgcgtgcgggatttccgctgtgtctaccagtcccgccagtaggttctttctcgccatgtgcctgctccgtttgcctgagatctaccgggccgtcccggggaagtttacacttctcaactgacaaccttcctcccccaagaggcatggacgagttcgacgatctcggcgttgactgcgttcaaggagtccatcgcgcgctcataggtggaccgcgtcatctgactcttgtcgacttcgtaaagggtctgcttggtgattccggcgtctgaaaccgctgtcgatttcagcatctggttcttcagcacaaactggtggaacaaggtctgcatgaagcccaccatctgcgcctgcggcccatccgttggctcgtaccgggtgatcagatagcgataccattcgagattgaccgcagcacccacatcccggatcggcttcaggatcccgcccagcatcaaaaggaactggcccatcgacatgacgtcgagcatctgtggatggatcgtgatcaggacgctcgtagccgcagtcagcgcggtgatcgtgagatagccgagctggggagggcagtcgatgacgacaacgtcatagcggtcgttgacttccgacagcgcgcgcgaaatccgcgtgaagaaggtcttgccatcgttcgagctcttgttcgacatcgcaagcggggtgtcgtactcgtactcctgaagttcgaggttcgcaggcacgatatcgaggcccgggaaattggtaggctggatgatctcactgatcgatcggcgttgatcgtcatatctgagcgcctcatagagcgacggcgacatgtcgagttcgggctgaaaaccgtgaagcgacgaaagtgacgcctgcgggtcgaggtccaccgccaagacacggtgcccggtcaacgccatgtactgcgcgagatgggcggccgtcgtcgtctttcccgaaccgcctttgaaattgacaacggcaatgacctggagcttttcgcccgaccgacggtgcggcacgtagttcctggcttccgatcgtccatgctgatcgagatactgacgcagttccgccatctgctcagcactataagaacggcgacccgacgacgatgtctgggggagggggccttttccctcaagatgaagtttcttcagcgtactttgagagacgccgaggaactgcgccacttcagagagcgagaactggcgaagcagtttcttggcattcggtgggaactgctgcatgcttaaaagatgcaatttctttgaaatcagatcgccctgttcgaggatgagatcctcgaaatgcatcggctgtgcgggagcgatgggcggcgaattagcgttcattgcaggggaactctcgaataacggtttttcggcccgagaaccgacataatcgttattatgtgcgattctcgccgactgacaaggaatatagagttaacaaagggtttataccgcgtcccgagcagcccctgctcgccggcaaaacatgcgtgtttctccttcattcctaggcacttagatggacgcttgcgctccgccaggcgccagcacttttccaggggagaaatacggccgttcgcctgactaccaaacgtcaccgcgaaatagcggtcgtattgctccccgcgactcacccgactcagccttggtgaatatattcgagttctgagttgctgcggttgcccggaaagagagccggggcacataactttgctgccaacttcttcattgggcccagcaattggttctgctcgacttgctttcaccatctgtccctctctgcggcgtactgtccgttacaggccatgccccgcaaaaatagaaggtgattcttcctgaccgtccagaagattgggattgacaatgggttgaaaagaccctgcttggctcaagtgagccgaaggattactttcgcaaatttgtatttgtccgctgagggttagacgcggatcacggccgtctatggacacgaattgttctcctgtgaatcctacaagacgcaagggggccttcgggtctgcaaaggcagacgtgacgcgacgcaacgcccaacgcgttccagggaaccttgtaggatcctacaactgccacccgattccgatttgtgctgatttccccgcggtccaacaacgacggagaaattcatgcagattctcgcgatctcaaagccgcgaaatatcgaagaagcccaacttctccgcagccatcacgaactgcgcgcccgcgtcttttccgatcgtttgggctgggaagtcaatgtcgtcggaggctgtgagtcagatactttcgacgatcttcaaccgacctacatcctagccgtatcgagcaacgatcgagtggttggatgtgctcgcctactgcctgcgctcggccccacgatggtggccaacgttttcccctcgctcctttctgccggtcacctcaacgctcattcctctatggtcgagagctcgcgcttttgcgtggacaccttccttgctgagagcaggggagacggctccattcatgaggcgacgctcacaatgttcgcggggatcatcgaatggtcggtggctaaccgctacaccgaaatcgtcacggtgacggatcttcggttcgaacggatcctcgcccgcgtcggttggccgcttcagcgcattggcgagccaaggccgatcggagcgaccgtggccgtggcgggcactctgccggcaaaggcagacacattcatgaggctccgccccgccaactaccgctctcaaatcatcagcacttttggccaatcagcgtaaggagaaatcagtggaacagcttcgctctcatcctcgcctcgtccgcaagcttcaggaggcgcttggcgaccagctctgcgttgctttggacgatagcaacgtagtagagataatgctgaatcccgatggtaagctgttcatagaacggctcgggcacggcgtcgcgcccgctggcgagatgtcgtcggctgcggcggaaatggtgattgggacggttgctcatgccctccaatccgaagtggacaccgaacaacccatcatttccggtgagcttccgataggcggacatcgtttcgagggtctattgccgccagtggtcgcgaagccctccttcacaatccgtcgtcgggcatctcgcctgatcccactcgacgactatgtccgctccggtgtgatgaccgaggcccaggctgcgacgatccgcagcgccattgactcacgcctcaacatcatcatttccggtggaactgcctccggcaaaacgacgctcgcaaatgcagtaatccatgagatcgtgaggagcgcgccggaagaccggctcgtcatcctcgaagacaccgccgaaatccagtgtgcggccgacaacgccgttcttcttcgtaccagcgatacggttgacatggcgcggctgctcaagagcacgatgcgcctgcgtcccgaccgaatagtcgtcggcgaggtgcgcgatggtgctgccctcaccttgctcaaggcatggaacaccggacatccaggcggcgtggcaacaatccactcgaacacggcgacttccgcgctccggcgcctggagcagctgacggccgaagcaagccaacagccgatgcacgaggtgatcggggaggttgtcgacctcatcgtttccatcgagcgtacgccgcgaggccggcgtgtgcgcgacatcatccaggtcgagcgcttcgccaacggccgatacgagatcgaatctgaccaactcaccgaagaacgggaggagcggcatgtcgcgtaagaatgaatttatctccatcgcgcttcttgcttcgccactcattttggcgtcggtagcaccggcactggccagttcaggcggcagtctgccctgggaaggaccgctcgagcagatccaggagtccatcacggggccagtcgcgggctacatagcacttgcggcagtcgcgatcgccggcggcatgctgattttcggcggtgagctgaacgatttcgcgcggcggctgatgtatgtcgtgcttgttgccggcatcctcctcggcgccacgaccattgtcggcctgttcggcgcgaccggcgcttcgatcggcctgaccaatgatcgcgccacttcgacgcgcccgagtgcagaaggggagggggcacatggctgaggcgctatccgaacgttaccgcaatcgcattcaccgtgcgctctcccggccgaacctcctgatgggcgcggaccgggaactggttttgatcaccgggcttgccgcggtcatcctgatctttgtggtgctgactgtctactcggcgctcttcggggttgtcgtgtggatcgtgatcgtcggcttgctccgcatgatggcgaagtccgatccgctgatgcggcaggtctatgtccggcacatttcctacaaaccctactacaaggcgaccacctctccgtggcggcggtattgaggaggctgatatggtcgcgctcaaacggtttcgggcaaccggcccatccttcgcggatctcgtcccctatgccggcctggtcgacaacggcgtgcttctgttgaaagacggaagcctgatggccggctggtattttgccgggccggactccgacagcgccacagacttcgaacgcaacgaactatcgcgccagatcaacgcaatcctgtcgcggctcggaaccggctggatgattcaagtcgaagccgcccgtatcccgacgtacgattatccctcggaagaccgctgccatttccccgatgctgtgacgcgcgcaattgacgctgagcgacgggcgcatttcgcgcgcgagcgaggacattttgaaagcaagcatgcgctgatcctgacctatcggccgtcggaggccaaaaagacagccgctcagcaaatacatctactcggacggggagagccgtaggaagacctatgcggacactgtgctcttcatcttcaagaacgccatccgcgagatcgagcagtatttcgccaacaccctttcgatccggcgcatggaaacgcgcgaggccgccgagaggggaggggagcgtgtcgcccgctatgatgaactgctgcaatttatccgattctgcatcaccggcgaaaaccatccgatccgattgccagctgctcccatgtatcttgactggatcgcgaccgccgaactcgagcatggtctgacgccgaaggtcgagaaccggttcctcggtgtcgtggcgatcgacgggctccccgccgagagctggccgggcatcctcaacagcctcgaccttatgcctttgacgtatcgctggtcgtcgcgcttcatcttccttgatgcggaagaggcgcgtcagaagctcgaacgcacgcgcaagaagtggcagcagaaggtccggccgttcttcgaccagctatttcagacgcaaagccggtcggtcgaccgggacgccatgacaatggtggccgaaaccgaggatgccatcgcgcaagcgtcttcgcagcttgtcgcctatggctattacacacccgtgatcattctcttcgacagtgatcgcgaagcgctgcaggaaaaagccgaggctatccgccggctgatccaggccgaaggatttggggcgaggatcgaaacactcaacgcgaccgaggcctatctcgggagcttgcccggcaactggtattgcaatatccgcgaaccgctgatcaacaccagcaatctcgccgatctcattcccctgaactccgtgtggtcgggaagcccggtcgcaccttgccctttctatcctcccaattctccgtcgctgatgcaggttgcaagcggttcgacaccgttccggctgaacctgcatgtcgacgacgtcggccacacactgatctttggtccgacgggatccggcaaatccacgctgctggcgctgatcgcggcacagttccgacgctatgatcgttcccagatcttcgcctttgacaaaggaagcgcgctcctaccgctaacgctggctgccgggggcgatcattacgagatcggcggcgacaatgcggaagggcgtaaggcactggccttttgtccgctgtcggatctcgaaagtgacgccgatcgggcttgggccgcggagtggatcgagatgctggtcgctctgcagggtgtcactatcacgcccgatcatcgcaatgccatgtcccgccaggtcaccctaatggccagcgctcccggacgatcgctctccgatttcgtgagcggcgtgcagatgcgcgagatcaaggacgccctgcatcactatacagtcgacgggcccatgggtcagcttctcgacgccgagcacgacggactatcgctcggcgcctttcagaccttcgagatcgagcaactcatgaacatgggcgagcgcaatctcgtccccgtgctcacctatctgttccgtcgcattgagaaactgctcgacggctcgccgagtgtgatcgtgctggacgaggcttggttgatgctcggccacccagtattcagagccaagatccgcgaatggctgaaggtgctacggaaagccaattgcgccgtcgtcctcgcgacacaatcaatctccgacgcggagcgttccggcatcatcgacgtgctgaaggaatcctgcccgacgaagatctgccttccgaatggagccgctcgcgaacccgggacgcgcgagttctacgaacggatcggcttcaacgagcggcagatcgagatcatttcgaacgccactccgaagcgcgaatactatgtcgtcacccctgaaggccggcggctttttgatatggcgctcggtccggtggcgcttagtttcgttggcgcatccggcaaggaagatttgaatcgcatccgaacacttcattccgaatacgaccgcgactggccggtccactggcttcagatgagaggatttcacgatgccgcgtcgctgttcaatgtcgaataatttgctcgccggtctggcggtcgtcgccgtaacggtcggcacaggggagccggccgatgccggcaccgccactggcgtcgcaaccgagtggacgcaggttctcaacaatggggagctggttgccctggtggggaagtccaatgagcaaattcagaaccagctcacccagatcagccagttcgcacaacagatcgagacgcagctgaacatctatcagaacctgctccagaacacggcgacgcttccgtctcatatgtgggggcaggtcgagcgtgatctcaatcggctccgcagcatcgtcgatcaaggtcagagcatcgccttttccatgggcaacgccgaccacgtactgcagcagcgattccagagctatgcaaccctcaagaccaacctgccaaggaatgagacattctcctcgacttatcaagcctggtcggacaccaaccgcgatacgattgccagcacgctgaatgcggcgagcctcacggccgatcagttcgacagcgaggaaacgacaatgtcctcgctgcgctcgatgtcagagaccgctgacgggcagatgaaggctctgcaggtgggccacgaaatcgcggcccaacaggtcgggcagatgcagaagctccgcggccttgtctcgcagcagatgaccatgatgggaacctggctccagacggagcagaccgacaaggacctggcgcaagcacggcgggaaaaattcttcaacgccgacgtcaagagcattccggaaggtcagaaaatggagccacgctggtgagccgcgccgttatcattgccttagtgatcctcgtcgctgcggtttcgaccacagcgacagcgctgatcgtcaactccagagcctccaacccatccgcacctgaggagcaacgcaccgccaaagaaaaattcttcggcgcggggaaggcgcttccgccgatcaaggatggtcaggagatgggtccaagatggtgaagatcagtcttgcacgttcgttgctgattgcaggcttggcttatgtcgccttcgaggcacgcgctttcgcgcaggaaggtctagtcctcacggagttggagaaccacgtctcggcagccgcgaaaggatgggaaaccaccatccttgacgcggcgaaatcgttgttttggattttggccaccatcgagatcggcatcgcggccgtctggctggcgctccaggcggcttcgctcgacagctggtttgctgagcttgtccggcggatcatgttcgtcggattttttgctttcgttctgacgcagggcccgaccttcgcgcgcgccgtgatcgatagcctgttccagatcggcgctggcggcggatcggcatcccccgctgaaatcttcgacgctggcattcgggtcgcctcacaaatgtcgcagcaagcccagttcggcgtcttcgaggacaatgcgctcgcaatcgctgcggtgctggcgatgggtgtcgtggtcatctgcttttcgctggttgcagcaattttcgtgtcggtcatggtcgagatgtatgtcggcctgctcgctggcatgatcatgcttgggcttggcggttcctctttcacgaaagacttcgctgtccgatatcttgtctatgccttcggcgtcggcatgaaactgatggcgctcgtgatgatagctaagattggatcgcaggtcctcttgggcctggcgaatgctccaaccgcgtcttccgaccaatttgtcacgaccctggcgatcgccggcatctccgtcgtggttttcatcatcgccatgtacgtgccgagcatcatccaaggtgtagtgcaaggcgcctcggtttccggggggatggaaacgatccgtcacggcggccaggcggcatccttcgccgccggcgctgggttcctcgcgggcggcgccgcgagaacgggtttcacggccggtcagtcggcacgagcggcgggttcatccctcgccggcgcggcgcttcggggtttcggcgcggggatcggatccgccagcagtgctgctggttctgccgccaaggaaaaggcgatcggttcacccggcgcctatgccggatcaatcctcggcctcgccaacgccaagctcgatgagagccggggcggtcatagcgggcacaagccacctcccgaacgcaaagactaacagcaatcagaaagtgatagacgatggcagcgaaccgcgcccccgaaaacccctatcttgccgcgcggcaggaatggacggaacgatacggatcctatgtgcgagccgccgcggcatggcgcacagtcggcattctgggcctggccatggccgtgatcggtttcggatatgctatgtatctcagcaccgaggtcaagctcgtgccttacatcgtccaggtcgacaagcttggcacgtcggtcacgaccggtttccccgaacagattgaatatgcggatgtgcgggtagtgcgcgccacgctcggcaatttcgtgaccagcttccgttcgatcacgccggacgccgcggtgcagaaacaatatatcgaccgcacctacgtgctccttcggacctccgatccgtcgacggagaagatcaacgcctggttccgaggcaattcgccattcgagaaggcaaaaaccgcaacggtcgcgatcgaagtcaacaacatcgtggcgctctcaaaccagacctatcagatcgactggaccgaatacgaacgggaccgcaagggcaaggagatcggcacgcgccggttccggggcatcgcgacggtgacactcaccgcgccgcaggacgaggcaaccatccgcctcaatccaatcggcctttatgtcagggattttgactggacagcgcagctttaagggcaggggaattctcaatgcacagaaccggattgatcgcagccgccggctgcctggcaacactcgtctttgcgagcgccgctgaagcgcagagcatgaccaccaatgaggtgaagggcaccagtatttcgaggaaatggcgcggcacggccgggttggtgacgactggtcccgacggcaaggtcatcttcctgttcggcgagacgcagccgtcggtcgtctgctcgcccttgcaggtctgcgatatcgagttgcagggcggcgaaatcgtgcgtgacgttctcgttggcgatagcgtgcgctggaaggtcgaaccggcgacctcgggtgccaccggcgggcaggcgatccacctgatcgtcaagccgtcggagccaggccttgtcacctcgatggtggtcacgacgtcgcgccgcacctatcacatccagctgaaatcccatccgagccagtatatggcgcgcgtcggtttcgagtatccggaggacgtttcgacgaagcttgctgacatcaattcaaggctcgagaccggcggcattccaggaacggcacccgacaagctgaacttctcctactcggtcagcgggagcgcgccgtggaagccgaaacgggtctattcggacggcgcaaaaacctacgtccaattctcgaaatcgatctccggacaggacgcgccggtgcttttcgtcgtcagcggcggccaaaaccgcatcgtcaactaccgcatgaacaatgacatgatgatcgtggactacgcggtcgacaaggcgatcctcgtctccggcgtcggctggcggcagcagaagatcactattcggcggggaggctgaacgatgcggaagcttctgatctcctttgttacggtggctattctttccggctgccaaacggccgaggacgggctgacgaccagttccacgccaaccaccgtcaccgggcccgcggcgagcgcgattgccggcgatatggcaagccggctcgccgagcagatcggcccgtctgcgacgatgaccatcaagatcgaaaaagactcgtcggatttcgcgagcgcgctcgaggcggcgctgaaaggctggggctatacggtcgtgactgatggcaaggtcggcagggtcggcaaggacgtgaaactggtcgagctcggctattcgatcgacggtgttgacggtcaggtgctcgcgcgactttcgacgccctctatcgcgcttggccgggcctacacggcaacggcagcgggtgctgtgccggcaagtccgctttccatcatgcagcgcaactgacggagacagatatggtccagtctctgcggcttggtgccgccaacgaggccgaagatcagaacggcatgcgccgtctcaatcgcctgccgatcatcgtcgccatcgtcatcgttgcgctgttcgtcggcttcgtcgtcatcggactggcatggcgcggtcttccgttcaaccgcaacaatgatatccacagcgcatcgaataccccggcaacgaatttcggcgaccagctcaagcgcggcgtcaccgacggtatcatcggcgagccggtgaaacgggaagcgtttcagccgacgcccaccatgaaacagaaggtcgacaaggaaccgactgtcgtcgaccggcctacggaaccggaagagcgacgcccgcggctcgaaaccgaggaagaatggaaggcgcgcctgatgcgcgagcaggacgaacaaattatccgcgaggcccagcggcagcggatggcccggctgcaggcacgagcaacggctttggactcgccgttgaaggtggatatttccgaaggcgagaaagcacccaagaactccacggacacgggtcaaaatcccacggcgacagaaaacaatgcctcggacctctaccccgccgccatgaaatcggggatcatgggcgagaacctcgatccgaacgcccaggcgtcgaaggaggatttcttcaaccaggacatcaaggatgatggctacctcccaaatcgggtcgtgccgcagatgtcggtctatgagttgaagcgcggctcggtcattcccgccaccttgatcaccggcctcaattccgacctcccgggtcgcatcacagcgcaggtcagccagaatgtctatgacagcgccaccggctaccggttgcttatcccgcagggcgccaaactgttcgggcgctatgactcaaaggtctcgtttggccaggagcgcgttctcgtcgtctggaccgatctcattttcccaaatggatcgaccctgcagattggcggtatggctggcacggacgccgagggctatggtggcttcaaggacagggtcgaccggcatctctggcgcacttggagttcggcagcgctgatcgcgctgattgggaccggaatcgacatgtcgatgcccgagagctcgacgctggcgacacaggatactgcctcagacgccgtacgccgaaacttcgctgaatcgttcggccgggtggctgagcagaccatatcgaagaacctgaacgtccagccaacaatccgcatccgacccggctataagttcaatgtcctcgttgaccaggacatcatctttccgtccgcctatcgtgacaattagcggcgcagggcccacagatctgatctccgtatctgccgctggttggcgcgcggtgtggcgctacaatcactgcagcgcaaaacctttcctcacttgtactatttctaggccgacgtggcttgaaagctgcatctccacaggtagtgctaatgtacacggtccgagggaatactccgcatgctctattaacctgcggttgccgcaaaaagtaattgtgtgcgtaaatcgcagtcatgacccgattgcccaaacggccgctcgtttcgcaaaggacgagctcggcggtcaagaagataggagagatgtccgtgaacggaaaccttcgctcgctcatcgatatgctggaagccgcgcaagatgggcacatgatcaagattgctcttagaagcttcgcgcattcctgcgggtatgacaggttcgcctacctgcaaaaagacggcacccaggttaggacgttccattcctatcccggaccatgggaaagcatctacctcggtagcgactatttcaacatcgatcccgtgctggcggaagcaaagcgccggcgggacgtttttttctggaccgccgacgcttggcctgcccgaggatcgtctcctcttcggcggtttcgtgacgaggcaatcagccacggcattcgctgcggcgtcaccattcccgtggagggaagctacggatccgcgatgatgctgaccttcgcatcgccggaaaggaaagtggacatttcgggcgtgctcgatcccaaaaaggcagttcaattgctgatgatggtgcactaccaattgaagatcattgcggcgaaaacggtgcttaatcccaagcaaatgctgtcgccgcgcgagatgctttgcctggtgtgggcttcgaagggaaaaactgcgtccgtaaccgccaacctcactggaatcaatgccagaaccgtgcagcactatctcgataaagcacgtgcaaagcttgacgcggaatcagtgccgcaacttgttgcaattgccaaggatcgcggcctggtctgagttctagttgtcatcgtcgaaaggcacgtcgggcacaaagccaagcgcgtccagaatgtccgatagctcctcctgttgggcctccgacctcttctggcgtgcaacgtactcatcctggagcgtctggaggaccggaccggaaatcgacggatcgtcgcttgcgcgcaaccactcctcgtaaacggcctgatcggcccagaggagccggcggtgttcgcgaatcgcggaaactgccagtgcctcaagctctgacttggtcatgacactgtagcgcgcttctttctccttgttttcgtcgttcacctcggatgagcccatatcgttcatccgcttctccctgatttgatttcctcactgcccagcacccaaggtcggcattgtatcggtctagccgctacagccaaattctctgggctgaggcaaggcagttgaatctaaactcgacatttaaacaactgcttcgagccgacgggcgttccgagccgccgcgtttacatactttagttgataaacttatggtgtgtaaacgacgatctttcagcgcatggatatgcgcaagctggtcggctctaatttcgcccgcctgcgtcgggagaagggcctgacacaggaagaggtcgaagctcgttccggtttcagccaacaatatctgagcagccttgagcgcgggcgacgcaaccctaccgtgattactctttatgagctggctcaagccttgggtgtaagtcacgtcgagttggttaccccgactgatgagactccgtttggcacgcgatgaggcgaataatcctactgcagggtaaaatcgagcgtatgcgccgcttacatcccattgatttcgcgtgtttgtgaacattgtgattctgccagaaggttttcggcaagagctggagatttgggatggcggatggtgatggttgcaaggcgtcccatgcgaagagccgttttgatgcggctgttctcacgcagggtcagttcctccgatagaaggatgtcgattgcttccagggctgagagttcgccatgctcgaggcggcggaccacgtggtcgagcgcctcgagagcacgcggcatcttgaggccgacgagatcgtgacggatgcgttcgatcatcgacggcatagcatcaagggcggcgctcatcggcgggtctcccgagccatagccgttgcaacagcgtcatgaccatgccgtcacgcgagattcgccgctccagcttcaggaccgatcggaacagggccaggggaagtggccatagatgagatcgctcttcggcgaaagcctcattgacgacgcgcaaggtcgtggcatgcaccctgggattggcgacggtatccagccaatggcgcagctgcgcgttcaggtcatcaaggttgcggaacgagcgagccaggaagaagtcttcgcgtatgtagcggaatggcctctcgaccttggctttctttcaagtccaggactgcagttcgtactgacactcaagcgcgtatagaattcgaggtcacgcacccgttccatcggtggcgcggccagcgcttcgtgttgtcgacacgcaagcagagctggggcgaggaccgcgtcaacgatacctgcagggtctgcgcaggttgatctgctgcgcgcactgatgggtggctataggagctgatgggtaactgtgagtcctaagactgcaagttgatatataagtccatataagtcagcgttttgatacggttttgtatatcgacattgcattgctctctaactccctatatattatcctgtatggttcgcatcctgcgatacaggataatgatatggcatataaaacggagcatataacgcagcagctgcgcgctgcgcgcgaagcgcagaaaatgagccagcgcgagctgagcgcacgatcgggcctgacgcaaagccatatttctcagatagaacggggcaccatggagcccggacttggcagcctagtggatgtggcgcgcgcgctcgacctcgagatagtccttgccccgaaaaaactgatgccagcaatccgcaatatcctcgatagtgcatcggcatcgagtgatgtcctgacatccgaccagcgcaaactggtggggcgccttgagcggtggtttgcgcagcacaggggcgggttcggtagtgcttccgaggcagatacattcaaagatagcctcgcgctcttacggcatcttcctctgtcggccgaggagatggacacattcaacgaggcgactgcacgcctcgaccggtcgcaggctgatcctccatcccgtcaggaactgagcaggatcgcacatgccgtaagacacctacgcaacgccgcggtgcaccgcgaccgtgacgacgcggtccctcgctcggcctatgcgctggatgaggaagacgataatgcctaaggtcacggtactcgatgtcaggctgtatggggaaccggtttcgaccctgacgaatctgcaggacgggcgcaccatcttcgcgttcaacgaggcttatatcgaagacgaaaagcggccgacgcttagcctgtccctgaaagacccgttcggggcgctcattacgaagttcaggccgtacaacatggtggtcccgcccttcttctcgaacctactgccagaaggaccgctgcgcaaatacctcgctgatcgtgcgggtgtgaagccgtcgcgtgaattcctcctgctctggatgctcggccgcgacctgcctggggctgtgacggtgcatccctccgaaggggatgacgcgcctccggatgacgagcaggctatcgtcgaagcgcggccgaacgcgctacgcttttcgctggcaggtgtgcagctgaagttctcggcctttaagaacgacaaaaagggcggcggcttgaccattccggccgagggcacgggtggctcgtggatcgtgaagctgccgtctcagcaatatagcggcgtgcccgagaatgagttcgcgatgatgaccatcgcccgcatgatgggtatggacgtgcctgagctccagctggttgatctcgacgccgtaagcggcctgccgcagggggtgggtgaactgcacgggcaggcgctggcgatcaagcgttttgaccgcacgccggagggagcggtgcatatcgaggactttgcgcaagtcttcggcgtctttcccgaccacaaatacgataagggcaattaccggatgatcggccgcgtgctggggatcgaaaccagcacggccgacgtggcggaattcatccggcgtctagtcttcagcacgctaatcggcaatggcgacatgcacctgaagaactggtcgctcatctatcctgatcgccgcacccctgcgctctcgccagcgtatgacttgttgtcgactatcccttatatcgagggggaagatacggcggcgctcaatttctcccgcacaaaaaagatggcggcgctgtccaaggacgagctggcgcatctggctgcgaaagcggagctttccgaaaagctggtgatcgacacggcgcgcgagacggttgaacgttttagggcggtatgggaggcggaaaagaaaaatctgccgatggccgccaaggtcgccgacacgatcgatacgcacgcaccgacggtcgagctgtatcgtgagttcgcgaagtagtgccttgcggctcggcattcaaattatcgagccttgctgtatattcaaggcgttagcccatccaaagcatggccgttggttcgaatcccatcaagacccacaaggcggaaatggcacatcggccgcataagtccaaaaactccggccgacgaagtccaggtcgagtagccagcctctttcctgcgacatgacgctgacatcttgaaggcccaccagatgaaagtcgctccgaaaaccggggcgtccggttacagttctttggacccgacgacggaggtcatgatgcggggatcctttaacgacctggtctatgcgcaaaatggccgcactctcgtgaaggaaatctgttccgtgagcaagcgatcgtcttcgtggagcgaaagcgactcgacgcggaggatctcgtcgcccgcatcacttggcaggcgttaagcaaatgccttgttggagagatgtatgtgaatgcggcgcgcgagacgtttttccgcacggcgaaaaacaagggcctccttgccgaaccggagatgtcattgagctcagttggccggttggctaagtgactgagcttccgcttccaggaacgcggacggcacgtgccttggagcgggctcatccacgcctggtcgatcaagatcgtttacgacagcactggagcggcggcttcgttgcctttgacggtgtgcaagccgaccaaggtcaatgtggcaagtggatgaatcagccatttggagccgaaggtaatagccgcaccgttgccttgtgttcgagatgattgaggacagacatcagggcaagggccatgcccacaacaacgacgccgatcgccgcgccgagcggccaatcgaatgagacgcccatcaagttgatgaccacgccggcgatcatgacgccctcggcaccgccgaccaatgtagcagcaataaaatcaccgaagccgagagagaaggtaatggtcgcaccagtgatgatacccggaatggagatcggcagaacgattgaaaaatttcccaatcggtcgcacccgcctccttgcccgcctcgatcagttcaggaaccggttcatgtagatgaccgagagcagcgagcttgcgaccccacctagcggcgtgccacgcgtgctgcttttgccgccgctcatgcgccggttcccgtcaccgtcccgctcttcgaccggcgccttaccgaccgatcccgaatggtcgggatgccgagcgggcgctcaccgccccccggcttcgggatcatcacccgtcgcaccagctgtggccggtagctcttcgagacgagttcctcccgcaggcccgccagccacccttccacgccctccgcctcgatttgcgcgaaggtcaccccgtccacgcccggcgaacccgcattggcgcgggccaacccataggcatggcgcagcatgtcctcacggcagatctggtcgtagagcacgtagaagcggaaagcgggctccgccttcgccttgcgatacagcttcctctgcaggttcctgatctttcgggtgtttcgagggtcatcgccaatcaccccctcctcaccaacatcgaaagcacatcagaagtcagggcccttccctccaccggcattacccggcttcagcggtattatggccctgtccgactcccgttcgcaccgccgcccttggctgcgttgggtctcccccgttacccgcatcacccttccaacgtgccgtgcccaatacccgggtggatcgaacgggtgcccatgtcgattgcttccccgttcacgcggccttccccgaatctcaggcacgtcggcatccacatcatcactttcgaggcctgctcaggctttactcgcattacggcccatcggatcgctcaaccgcccaaggtggcctttgtcacgaggcttcgacccggctagttacccaaccgaaccggtcgctagctacccctatcgacaactatctgggtggaaccttcctccactggtgatacgcgccatcggggcgcactgagagattcgggttaggcctcacgttcccccgatgcgggaaagatcgatccgcattgctgccgatccaacgctgtcgtttccctcaggccattcagaggccgagtcttgagtatgactatcgcggtcatccgaccgcaacacttcttccgtcgcaacgctgccacccggatcaggagcctgaaacacgctcacgccttcgaactcacccgtcttccatgcgtagacagcatcctcgaatatttgagggatgacgtcgtcgctctcgggattgccatacgacttggcaacgatcctaagaaccttggcaaacatcgaggttcccttgcgaaggttttcgcaggcgtcgacgaggtccggctgaaggtctgctgcgttcttcacgccgacgcccactggaaactgtgtcaggccgacgcgaaccaccgcctgacccacatattgcctcacgattgccatcgcctcgccggcggaagtcgctttcggcacgaggatcaatcgtccacccgattcaactgaaacggcgagcgggtccgtcgagccggcggctgcgacgaactgctcgacgatcgcgggcttgagagaaggatcggcgcattctttgattagggcagcgtcgagcatgacgtctcctcgggcttcaggtgttgaaggaaagaacaagcggtttcgcgaacagctttgcccaagcgatcgcgttgactcgctgaatcgcgacgatggatgtccctttggtccaccatccgtttccgactgcgacgatcaggtccggctcgtagagcatcgattgcaaagtgggccagacgacgagctgctcgtaacaaatcaggggagcgacccggctattgcctacggtcacgacagggttggcaaagaagtgcgcccgggcgccgtcgctctcaccgagccacgatccccatggctgccacatggagcccgggaccggcattcgctcgcgatagaggaccctgccgccatcggccgagagggtgaccaacacattgtcgtatccggtcgcgtcgatcgccgccgcgccggagatgacggagatctccgtgccctgcagagccttgacccagagccgttcgaaggtcggtgtccagaagcccaaggcgctttcgggcagaactacattccggacgccaccagatgcgcggtccttcaccgtggcaatcagatcacggtgacgctgaatgctggtgttccggccgagcgttgaccccagtttgagatcgacgccctgccagctcgcaggtaatttcgactcggtccagtttgcggcggaccaaagccaaaagcctgtgaaggcgattgcgacagccggccacatgcgggttacgaggcccatgaggccggctgtcgtcgcgaccagtccccaccatccccatcccggaaagagaattcccgcggccgtgacaggatgcgcccagccggtgatgcccattggcggcacagccataaggacagccgccaggagatagcgaaacggtcgacaatccgaacgcttcgtccagagcaccgtatgcacgacaacaaagctccccgaggcgcacagccacagcagcaagcccggccacagatcggaggtatagaacgccgcgacgccttgcggcagcccgcgtgacgccgccaggaagtatccagcggaaacgagtgccgctaccctccgcgtgcgcgcgcgcgaccaaagaattgggaatgccagtgcgaccggaagaaggagggcataaccgctccacccgaccgttccgactacaattgaagcgatggtcagcagtctcggctggaggtgatcacggcgcataggtcaggacttcttgcgccaggccgagaatgccggcggccgggatcggaccgaaataacgggagtcataggagcccgagaacggcgagtgcaggaacacgtaatcggtcggcacgattccgcccgagaacggcttcatcggccgtccctgtccgtcgcgcagagcaagagcggacgaggggacaggatgcccgtcgacgttgacgctgacccccacctcgacccgttgccctgcaactgcgatgaccgacttgatgagcggcgcgatgccgcccgggcataggccggcgcgcagataaccacgcattcgcgcctcccgcatggccgaggttcgaggcggacaaatgaagacgagatcgccgacggcggatgggcgatcgatcttgacgatacgccagagaccgagaggttcactcggcgtgagattgatccggtagccgccgaaccaggcggccgagatcgtgccgaccgccgccattgtcatcgtggctaacccgaggaggagcggcttaccgcgtcgcctcctcgaggtcaattcaacgagaggaatgttcatttcagcgacagcccctggctcttcgtctgccgcagcgtctcggcctgctttagggcttcgatcgttcgctcatgggcattgagttgctgcaccgtacgcatcgtgttccaggccgattggacctccgccttcgggcctgggttcattccagctgtgatcgtcttgaacgtttctccgttcgtgtccttggcggccagtggcaggaaggcgcgctccccgaagcgctcggtgaccgccctggcaaagccttccaattcggccttgacttgtctgtcggcgagagcaaactccaacgccgcgggtaggtcattgcggtcgatagcatcacgcacgcgctccagcgtctgcctggcgcccggagacagcgccggaatctcgatcgccaccttgcggcggactgccagttcatcggcctgatagcactgttcggcccggctgcgctggcgcatgtaatcgctgaggctctgggccagagccggtacatttcgttcggcccgctcgcggtcctgcttgtcggcacggcttgcgagcaagccggtttttcctttcagcgaaccgtaggattccggctgattggccatgttcgatagcgcggacttcgcgacggtctcgtccttcagcatcgcgtcgacattgaccgccttgaaggcgacttccggctgggtatagacgagatggaagcgggtcgagacatcctcccattgcttcttcaaaccgggatcgacttcgagtctgtcagcgactgcctgctccatcgatttcgggaaagtcgcgataccggcaaccatgggcctggtctccttgaggttttgcgagttggttgttttggcgcccacggcgagaccgaacctcgcgccgatggcgacgagccgctgagtcagatcggccagtttctgtttctgccggacggtccactcgagccggtcgcgggcaatcgtgcgggcgacattgacgaggtgcatgccgcgggcttcggcgaagcgcagcgcctgccggtagaaggttgccttctcgtaatcgagcgtggtttccttcgaattcttctgcgacaggatctggatgaggccaccggacttcgcaaaggatcgggcgccgtaatagaccccgagatcctcgcgatggcgggtcatcgcgacataggtcagatgccgatcgagggagagcgaagccagcaccttcacccggtcgacggtggccccctggctcttatggatggtcgtggcataaccgtgatcaagattgttgtagaagcggctctcgaccatgacctgacgccgatgctcgacttcgccgatctccgcgacgatgcggttctgagcggcctcgacgaccttgccgcgcatgccgttcttgacgccgagcgcgccctcgtttttcaggaagacgatctggtcgccaggtgcgaagcggcgatttccatcctccgccttgaatgagaaaccagcatcgacaatgccacgctcgacgagcttggcgcgcgccatctggttgagcatgcgcacatcgcgccgaaggtgcgcgaggatcaatgtcgtcttcgtcggatcgtaatcccggtcccagtccgcgatcagattctgaacagcttcagccttgagctcggagcgcatcatcctgccatttgcacgataggtatcgactaccttgccgacattgccacgtgcgaggtcgagcgacgcatcgcacatccactgttcgcgctggcgatagatggtctccagttcggcataaccgatccgatcggcaatggcgcggaaagctgcacccgcttcgatcggctgcagctgttccggatcgccgaccaggacgagcttggcgccggccttcgtcgccgtttcgacgaacagcgccatctgccgcgatgacaccatgccggcttcgtccagcacgaagatcgtcttgtcgtcgagctgctttcggccttcgttccagcgcagctcccaggacgacaacgtgcgagacgcgattcccgcttccttttccaaaccttcggcggccttgcccgcaagcgcaccaccgacgacacgatagccggccgcctcccatgcttcgcgcgcagccttcatcatcgtcgtcttgccggcgccggcgcggccaatgacggcggcgatccgctcggctccggccacgtgctcgatcgccgtcttctgttcgtccgacagacgggaatggcgactgaacgccgcctctagcacttccttccgaacgccatgcgaggatcgcctcgagagccagatcgctcgggatcccatctccgcttcgagccggatcagctcgcgcgtcgtgtattttgctggcgcccggatgccggtcgcaaacgcaatccgctcgcgttcgagacggagcgttttggggctctggagaatgcgggccatcaggctatggaagaccccggggtcgtcgatatagcgatgcaggatcttcgccacatcacgctcgtcgaagacgctcttctcccgggtgatcaggtcgaggacgatttccgggcggcgctggatgcgtcgagcattctcggcgcgtttctcctcctgcagctccagccgctcaagcgaaacggcctggtcatcggtcgtcgctttccgctcgatcgccttggtgcctaccccgagatgaatggtcggggtaagctcgatgccctgcttctcgaacgaacggccatcgatgcgaatgtcgagaccggcaagtgcgagatgccggttctggcaggcaaaccagccgtcgcgaaacgcattgaagtcgtccaggcttccggcccacagttcatagacgatcttgccggcatcgttgcggagcgaattgccgtccggcccaacaaccgcaagtttcttggccccgaacccatcagcagtcagcggcctcaacgtcgtcatcagatggacatgcgggttgcccggtgcatcgtgatagacccagtccgccaccatccccttggcggtgacatgccgctcgacgaagtcacgcaccagcacgatgttctgctcggttgtcaactcgatcggcaacgcgatcgtgacatccttggcgagttgcgcgtcggagcgcttttcgaaatcctcgaccttgttccagaaggcttccgaggcgctggcgaccgagcgatcggcgatcatcgaccgcaaccactcgggtgattcggctggaatgacgaactcttcgtgaagaagaccctgcttggcgcgatagtcgatcgtccgggcttcccgctcatagtccatcctggcgcagtgccgataggccgccgacagcacggcgctgcggccggagccgcgggcgacgacgctgacggagaaatgaggaacggccacggcagagtcttcccgattgcacacgaaatcaatgggttcgtcgggagcggtggccccgccagggccgcaaaacaggatgtcgcgacagcgacgtataattgcgcccttggaagccgctccttcggaacggccgggatcattcaccaaagcatcgcccttggcgattgtaggattcacagtagtgcgttccgcactccgctccgaaaaactggcttcgaaagacaagctttctcagccacggagacggacggaatgaagaaacctgcctcgaaaattcgcgacgaaatcgccaagcttcaggaacagctcagacaagcggaaacccgcgaagccgagcgaattggccggattgcgctgaaggcaggacttggcggaatcgaggtggaggaagccgagcttcaggcagccttcgaaagcctggcaaaacgctttcgcggaggccaagggggagcgaacggggcttcgagcggagggaaaaagccagatgggaatgccacggccggcgcatcggccgcggcggtcgggtctggcgcggctcagggcggcaatggcgaggcttgagcggatggcgaggtcagcgacatccgacgcccgcaaaaaggacacgcgggagaagatcgaactcggcggcctgatcgtgaaggcgggcttgcgatacgagaagcgagtgctcctgctcggggcgctggtcgacctcagccgccgtctcaattccgacgaaagcgagcgcgcccggttgatcgcgatcggtgcggaggcattcggcgatgacggtgaataggatcgcactcgtcgtcgcccctgtcgtgctgatggttttgaccgtcatcggcatgagcgggatcgagcaatgcctgtcgaccttcggcaagactgacgctgcaaggctggctctcggccggatcggcatcgccttcccctatgtcaccgccgcagcgatcgcggtgatcttcctgttcgcgagcgcggggtcggcgatcatcaagttggccggctggggcgcgttggcgggaagcgcggcaacgatgttgatcgcgacgatgcgcgaggcgtcacgccttgccgcattcgcagcgcaggtgccggcgggcaagtccattgcctcgtatcttgatcatgcaacgctaatcggcgcgacggcggcgttgatgtcgggatgtttctcgctgcgcgtcgcgctgatcggcaacgccgccttcgcacgcgccgagccgagacgcatccggggaaaaagggcgctgcacggcgaagccgactggatgaacatgcaggacgcggcaaggctcttctccgatgccggcggcgtcgtcatcggcgagcgttatcgtgttgacaaggacagcacggcggcgcggtcttttcgggccgatgatcccgaaacctggggcgccggcggcaagtcgccgctgctttgcttcgacggttcgttcggatcctcgcacggcatcgtcttcgcgggttcgggcggtttcaagacgacgtcggtgacaatcccgacggcactcaaatggggcggagcgcttgtcgttctcgatccttccaacgaagtggccccgatggtctatgagcatcgcaaagcagccgcgcgcttcatccgcattctcgatccgaaggaaccggaaacaggattcaacgcgctcgactggattggccggttcggcggaacaaaggaggaagacatcgcctcggtcgcgtcatggatcatgagcgacagcggcggcatgcgcggcgtgcgcgacgacttcttccgggcatcggcgctgcagctgctgaccgcgctgattgccgacgtctgcctgtccggccacacggacaaagagaaccagaccttgcggcaggttcgggccaatctggcggaaccggagccgaaactgcgcgagcggctgcagtcgatctacgacaattcaaattcggatttcgtgaaagaaaatgtggccgcgtacgtcaatatgacgccggaaaccttctccggcgtctacgccaatgcggtcaaggaaacccactggctgtcctatccgaactacgccgcactcgtatccggttcgaccttctcgaccgacgcgcttgcggccggtgaaaccgatgtgttcatcaacatcgacctgaagacattggagacccatgccggtcttgcgcgtgtgatcatcggttcgttccttaacgccatttacaatcgcgacggcgaggtaaaggggagggcgctcttctttctcgatgaggtcgcgcggctcggctacatgcggattctggaaaccgcgcgtgatgccggtcgcaagtatggcatcatgctcaccatgatctaccagtcaatcggccagatgcgcgagacctatggcggacgagacgcggcgagcaaatggttcgagagcgcgagctggatttcgtttgccgcgatcaacgatccggagacggcggactatatctcgaggcgttgcggcatgaccacggtcgagatcgaccaggtcagccgcagttttcaaacgaagggatcctcaaggacgcgctcgaagcaactggccgctcgaccgctgatccagccacacgaagttctgcgcatgcgcgccgatgaacagatcgtgtttacggccggcaatgcgccgctccgatgcggccgagcgatctggttccggcgcgaagacatgaaggcttgcggcggcgaaccggtttcacaaggtcggaaagatgtctgaagcccgcctgatccagccggcgcgcagtgcaacgagcaaggcggatccaggagcatgaagagtatcggagaaatcagcgtgagcgccgcccaacaggcgggatttcgggcattctcgtcgtgcgaggagcgggaaacagggcagccgcaggagcctcaacatagtggcccgaaggggaggcgggaacgactgctccccgcttctgcacacagttttgtctcctgactttagccaacacgtcaaaagcggacttgctgtcggcttcgctttcgatctgcggtgatggccgccacatcaactgcgtcgtcgatggcggttctggttcgagggcgaaaaaatccgcattgccgatttcgacacacctgagtcgcgccctccgcgatgcgaggccgaacggataagggggaggaggcgaacgcacgccttctcaccctgctcaacgcggggacattctcgctttcaaccgggttacgagatgaggacaagtatgggcgcaagctccgcacggtgacacgagcggggcgctcgctggggcagcacgctcgttcatgagggccttgccaggcgctgggacggtgtgcgacacggctggtgtgactgagaggtcgcgagagaatcgtcacccgacggggcggggaccgcgggcgggctccgtgagcgcagcgagtagagccgtgcgccataggcgtctcgcccaacatgctctttctcataacatcagcgatatgaatcgatccgtgcccaccgattcacaagtgtcgttggacgcgatagtcgggatcagcgattctgatctcatgatctcgcaaccctaccggctctatgtcgagcgcctggatccctcgaggaatatggcccgctactatgccatgtcgatcgaaccgaacctcttcggcgacatctgcctgcttcgcaagtggggtcgcattggaaccaagggacagatgatggtccatcatttcggccaggaagaggatgcggtccgattgtttctcgatctgctccgacagaaacgaaaacgcggttatcgtccgcgaccttccttgccgaaggaaaaatggcccgccgaagcggagcacgaaagcgctacatccgcgccggttccagatccggaaggacacttggatttagatgaagaacggaatcttgatggcgagctttagaccgagctttcccttccggaaggaatggctgctcacctttgccgaggacgcggagccgtcggccggcgcgaaatgttgcggggttccggcaagaagccgatccaacgcctggcgaaggcgccagccgcgacagcctcatcgaagacatcggaatggcgcgccaccaccgcttatgggttcctcccggccggaggggacgtccggcctcactcgccccggtacgaatctcagggtgtgctatctgacccggctgatctcggtgagcgatttgcggcgcgcgatgaactcgcggaggaggggaaggaagaacgctttgctgaaccgcccgatcggcggctcgggctcgatgtaaaaggagcggccaacgatataggtgttgaattcatcgaagatgatccagaggcgcaggtctgcatcgaggccggcccgccgcttctcgatggccggaatttcagccgcgcagcgagcctgctcgggctgcttggtggtgatcgggaaaaacagaaccaggtcgtcatcaggtcgggcaagcctcacgccgacggcgactggccgatacttccgccgctctatctctccttttcgggcttgccgcgcgcataaatagggataacggatgaccgtcgcggtctggatgccattatagctgctcatcgattggtctcgtcggtttccccataggcgtccaccgccgcctcgaattcgttgagcagctcgcccggcagggtttcgagtgtgccgactgaacgggcatcgtattgccgcatcagccgttcgtagtcgtcgatgttaaggaggacgaggcgcggcttgttgcgttgggtgatcgtgaccggatggcgcaacgcctcggcgatgatatcgccggacttccgggatagatcgcttgttgagtaggaaccaccggggcgaggcatgttgatctccagatgtctttgccggcgggcaccatagcatcagaaccgacgcaaatccggcatttacagtattgttgtaaatgctgtgtatttccgcggtgaaaggccccgcctggcggcgaggccttaatcgagagtatcagtcccggttggggcgggaccagatgagctggtagccatcttcgccttcgacttccgtcagcgtcgcgtagatcggggccgggaagctcgggtcgtcgagcttgaccgagaggtagtcacggtcctgctcggagcgcttctgccaggcggcgcctagttcgacggcacctgcgtaaatgcggaagtgcgggcccttgtccgagggattttcgatgcggccgatgcgagctttgacgttaagggcgagggtgcggattgagccggtgaagccgttttcggtagaggtgaaggtgccaatggtagccattgtcatgttcctttcgttgtttcgggccgcgcccttcgcggcctcgatggctgtcggaaagaccgggggcgatcggtccgcacctgaaaggccgaaacattgtggagggcgggcaggaagaactttgttgttccgtgaggaatgacggcggagccggcaggggaagaaagttctgaagggccgttgcgggaagccaatcgaggcgaagccgttctccggtcaggcatgcctcatcgagcgccagaagtgagcgccgcaacaatgaagagaaggaacatgggactggctacgctcgcgcctttcgatcgaatgtgtccaaacggctcataggtgaaaccgctccggatgcctggtcgtttgccgcgagcacctccgtatggagcttcgcagacgcgtgatccggccgcggctccagttcgggcgcgataccgagatcggcgcgtaggaagcaactaccaagctccgcgacatatcctgacagtcaagccgtcagcagcgacggggcgacggatttctcccagtaaacccctgtcaacagcgttgatcagccggcacagcccgacagcctggcgacgtccttgtcgaaagccagcgccacgagtttcagcccttcgacggtggtgaggtacggaaaaatcgtgtccgccagttcgtcgacggtgaggccctgccggaccgccagcgtcgcggtctggatgctgtcggcaccctccggcgcgaggatgtgcgcgccgagtaggcaacgggttccagcgtcggcgacgagcttgatgagccctcaggtatcgcgagcggcgagcgcggggggcacctggtcgagaccgatcgtcaagacagggaccgcatttcgctcggcgcgcgccgcggcctcggtcagcccgacgctcgccatctgcggatcggtgaacacgatcgccggcatggcgctgttgtcgtagcacaggccgtcgccgttgagggcgttcctcgccgcgagcctggcgccgtaggcggccatgtagacgaactggtcgcggccggtgacgtcgccggcggcatagatgccgacccgggtggtgcgcattcggtcgtcgacgacgatgccgccgttcagcgagacggcgatcccatggtcggcgaggccaaggccgtcgatgttgggggtgcggccggtcgcgatcagcacctgatcggcgtcgatcgcaacgtcttggccgtcgcgcgtgacggtcagtagaacgccgccctcgatcctgcggatggcgcggtaggcgatgccggagacgacggtgatacactcgtcctcgaaacccccgtcagcgccgcgccgatctcgggctcagcctcggggagcaggcgcgaccggcagacgagcgtcaccttgacgccggcgcgggcgaacatctgggcgagctctgcgccgatatagccagcgcccatgacgagcagcgaacgcggcagttcctcgaggtcgagcgtggtcgtgctggtcagatacggcacggtctcgatgccgggaatggcgggggccgccggacgtgcgccggtggcgacgatgatcctgccggccggaatgcgcgtgccattcacctcgacaccgccgtcgatgaggcgcgctggaccgacgcgataggcgatgccgttatagacggggagcaggtcgacatacttggcccggcgcagatcggaaaccagcatctccttctgatggacggttccacaccagtcggtcagttcggcctcggcggtgatgccggcaaagcgggcggcggcgcgtgcattgtgcagcgtctcggcggcgcggatcagggtcttcgacggcacgcggccgacattgacgcaagtgccgccgatggtgccgctgccgatgagcgcgacttgcgcgccctgatcggcggccgtgatcgcggccgagaagccggccgagccggcgccaaccacgacgaggtcataggcacctccattgcggccgttggccgggaagggccggcttgcgaccgtcgcgctcttcgatgccgcatcggaccggcaaggctcggcccgaaaagcgcgcggccggcctcgagcccttcctcgatcgacagccggaagcccggctcgtcggcggaacgtctgtcgcgccaggcggatagatgctcgtcagagcagaaaaacgccgtcgtcgcgcagagcgctgcgcagccgcgttcatagcggacagtctgccacatgacgaccgtcgacggcgcgacctcggccagcgcccgtcctcgctgccgcgtggtgatccggatcggcgcgccgcaatggcggcattgcgaggcaatagcgatgtcacgattggtcatggcgccgatgccgagcgcgtcgacggtgcacatggcgttgactacgtgtccgtacagcgtcacccgatggcccgtctcccggtcggtgaagggataagcgccgacgatctgctcgccgtcgagaacgaccagagcgcgccggcgaagttctgcgagcagaggccggatggccgccccgctgagttcggcgcgctccgcaagcgcgctccggcttggggctcgtccgtcctcggcatacttaaccagcgcgatgcgcacgcggtccgccgctgtatcatagccgctccagcgcttgagcacatggtcggagccgaccatggccggcagcgcgttccggactaccggcgacgtgacgaccgaccagttgggaaacgtcacgcccggccgcacggcaaagctcggcggtgtcgcgggcacagaaatgacagccttgtcctggggggaggatgcgcagcaattgtttatggcttcatgctcggacgacagcgcctggtcgcagccggtggcattctcggcgcgctcgccgcctcgtcctgttgcatcattccccttgtcctgttcagccttggcatcggcggcgaatcgccgacctgaggcgcatggagcgcgttctcaaatccgtcgttgcccaatgcggcgacggcacgctcccggagtgtccgttgatcgaaacgttgctccaggagcgaactgtcaactgatcgctgggggcgcctatgcagcgccccggacctcgttcctctgagcgtcgctctgttgcgcgtgcatccagtcggcgatctgctgcgccttgctcgccgcagtgaagatggcgcgctggtcggagcgcagcgcctcgagccaggaggcgatgtaccgggcgtggtcgggtctcgcctcgacgctgaggttgagatcggcgcagatcatcgcgctcaacaactcgaccgtgcattcctccatagcgtatgcggccgagccgaagcgtccggaaagatcgcggtcgaggcgatgcttggcgccggaagcgtggccacattcatggagcaatacggcgtagtaggcgaccgcgtcgcggaagcaggcgaactccggcatctgcacatgatcggtagacggacggtaataggcctgcgaaccgccgtggcggatgtcgatgccgagggaagcgcagaaccgttcggcccgctcgatccgctcggcctcgggcagcaccggcatctcgggcggcgtgtagccgtcgacctgggcgcagttgaatacggtgtagccgcgggcgaacagacgccgggcgggctcgtgacgatcctcgtcgccgtgttgggcgtccgccgcgtcacgatcggtcgtcttccagaacacgaccaagtgaccgcgctcgcccttgcgaacctgagcgtcgagcgcctgccattggcggtaggtgccccagatgccggcggcatagccttcagcgtgcgccgcagcccagagcgagaggatgttgacgccgcgataagccttgcttgaggcgacgttgacgggcgtggtgatggccgatccgtcgtgatgccagggcatccggtagtcgctggcgcccgcctcgatggcggcgatgatctggctggtgacccgctcgtagatatcggtcggggtctggggggtgcgatctgtggtcattgctgcctccttaagctcgccctctccgtcgagggcgaggcgccaggggcagacgcgggaggccggcccgtcacaccctgttctcggtgctggtgcggaacagggttgatgggctggcagcgtctgccacacccgagccctgcctcgacgggcgagctaaaggaggcgcagatcatgatcggcgcgcgcggaacagagcggttagatgatgcgcggctctctcagccggcgtcgtctcgccgcgagcacttcaaggcgacaaccctggcgtcaacagatcgggccagctccttccgcagccccttcgatgacggcatcccgctcggcgatcgaagcctgccacggcccgctcagcatcaggagccagactcagtccgaacctcgtctatgttgatcaggaccaccatcattcgctcgaggtcctgctggaggatactgcgctgaagatggacgagtcgattctcgttcaacaggctcctggcttcttgcgctgaacgggcccaggcgggccgatgtcttgcggtgatgcaggcatcaggaccagggtcggctggcaaaacactgtcagcgggcctttggcatcagttgcctgcttcaggcaggcggcagtgccgggatcgaagaagcagccggccagcacccgacatgcaatgttcgctcgaggctcgcgagcattgtgcggagccgggcacggtccgcaatcatcgccggaagcgggccgagttctgccgatatgccgtcaagcgtcttcgcttatgcgcgttgccgcgggtacgggctgcgtcgcgccgacctggcgcaggatcatgccatcctccgtgatggaaagacaatcacctccactcgaggtgagatcttatttggatatagagatattggcctttctgagcgcttcctctatcgattttgctccaagcgcctcaagcgcacgagcaaggctttgttcgacttcagggatacgttttccctgaatcagcgcgatctcggcgacagatctaccttcggacacccatcgaaggcaagatttttcgatgggtgagagcatggtttcccaaatccaaccgccagattatgcactacggaccatcggtctcggaaaccaagagcatcgccggcgaaaggatggcttacaggcggccatatactcctaccgacttcttgatgagggatggcgagcgcagtgaagcccaatgcctcccctatccggcgagaccaccctccgccacttagtccacgtggagttcagttcgagttcggacctcagcagcaggaaagcggcttccgggaggaagccgacctttccatgagaggatcccctctgcctgcgcagggtagtttaaagccatacgcagcgccggctgccacagcgcgcgcgtccgccgccttgagcactgttgatggtcagcgcgccggctctcgccgaaaatgtcgcagcaatcgcgatggctgcggaatgcaaggacgagtgacagtttcatgagcttctcccaagtttgaagatgcacacctcttgcgtgggcccctttgccacttaattacattgcgcaaattaatcttcgttgcaacagattgttcgaaccgtttgtcctaagccggacaagaatgttggtggccggccaggatttcgttagttccggaccgcggcgccgacaaatggtgcggcgtaaggggcgcgccaattcggcacggaacttgctgcgaggatttcgtttaaagcagacggcagcggcagatcttcggtggattagccggccgtgggtgattagcgcttagtatggcgtcatgaacaggcgtgtcacgttgttttcatcggggattgatcatgcgagtagcgctgatttctacgtcaatatttgccttatgttgttcgtcaaatgtcagggcagaggcggtgcttccagtgaacccgtcaccatatctggtcggcgccatcacgagaaacatgtttagagtgccaaaacctgaccaggacttggttctactatctgcgcaccgcggatcttgggaggtatatcccgagaactcagcctacgccttgcaggacgcctggaattcacagattgaggccgtggaggtcgatgcccgctttaccgccgataaggaagtcattctatctcacgattacaggatggagcgcgagtccactggaaccggcttcttgtacgatcagaactactcgcaagtacagcaagccgatctacgcgaccgtcatgggcgcgtgttcaaggactcgcgaggacgcaacgccaagttcatgacgttttccgcggcgcttgatctgctcgcgcagtacgtcacagatgatgggcatggttatgtgatgatcatcgatgtgaaaggggcggttgacgatcaggatcccactgatcccatcgagctcacgcagcgttgccttgatattctcgcggccaaaaagaacccaaagctcagcaaggctgtggtgtttaagctgaaggctaaggatgcggtggatattggtacgtttctgaatcggaccacctacgatcccaacgtcatgggcgggttgatcgtagttgaaaatccggacgatcagaacgttaaggattccaactatgatcctcacgaagatacaatttacgatcagtggaatgtggcgccgttccccgtccagtttgaaatgaaccaattctacaagggtgacggtcttcaggcgtatctcgactatgtcgatcaaaagcagggcttcgccacctatcatgaaagtaattattatccggagggcgtcgccaacagcgcgggaaaatgttgttttgagcataacaccgatcccagatccgtcgctcacggaggtatagtgccggactatcgcggcgaaccggaaatggcgatcgtcaatcgtacgaatctgatcaccactgactggcccgacgtggttgccgacatgctgcgccagttggggcgccgcaacaccagcaaactgagccgctaaggtaagacctaccgcttagagtggaatcttccaatgataactggaaagacaatctctctaccactctctgtaatagcgtgtcttggtgctggcgcaagccaagctgccgcatgcgccaatcagactgactgccttaaaagcgcctcggcaaaagtgtctcagacactcacccccaaggtagtgcctgtttttggcgattatccgaagctgtatatacacgactctgctgcgaatgaggattatacggtgcctgatactacaaagcaggaatttgacttttatacgaataagacttcatttaacctcccgcgtcgctcttcaatcgagacaagagagatcgcctcgatcagcccggccatggggttcactgtccttttggtcgaaaagacccgcgataatacggtttccaatggcggtagcacactctcgctattaagttccaattccaacgacgcttacttgtcattcgctttaggcgccaagcccagctcaagtgggcaaaagtggtcttttgccaaaagcttgcttcaaggcaacaaggcgcaaaccgcatattggcagaagccgtgggatatgaatcttctgggaccaacaggcgacttctccggaaccgagtggatctattacaccttcactccagacggcaaggttcgcatcgaccgtttcgcgccgtacacctattttctggcgtttaccgcttaccagtgggatgaggccgtgcttgacggtggcttcccgcattttcccttcgacaccggtacgccgaccaaccggccgcagtccgtcactttcggatccgtcgggccatggcttattggcgctgctggtgcgcccggacaaaccccgccgacgagcgagccaatagaggcattgcccggctttgagggagcgacaatattctcagcgcccttgtcgatgaaggaagttatagcttaccagaattcgctgaggggaagttattttctcgacgtggacatgcttccctgcaacagcggccagtacctttccggtcgaattagtactccctgcggtacaggtagtcccggcaatccgccaccgaacattaactctgtcgctcagcataggatcagcaccaataccaatcgttaggtcgtggcaagcaaaactttggccttgcctcaacgacgattgaaaagattttcaaggcaaggaggtcgatccgatgaccagcaaactcgggccaggccgcgactccggctttgcccgccggatgcttcgaccaatgctaatcagaagagctcgctgacgagcgccgcggaggtttgctgacgcaccgcgacacgggcctcagggcattggctgcggatggtctcctcaacctgccagagcttcgccatccgctcgaccgtcgctgttgcgaccttcgagccttccgcgacagtgcgcagcgtttcggcggtggcgcgaaagagcaggccgtagacgagcgccttgttctggtaggcgatcgcggcgatggcctccggcagtgtgaagacgacatgaaagtactgtgtgtcgagcaactcggcgcggcgatcctccagccattgcgcacgggcgagcgattggcagcggggacaatgcctgtcacggcagcggttgaaggcgatgcgccggtagcccgcattgatcgcacgcttcgacgtgcccgccgagcgcggcggtggggcacaactcgatcgccgtcatgacgcgacgctgagcggtcgacagcgacgtgtgctgggcacgataggactcgccatagcgacggaatatatccgccacttccggcctcgaacggggcatgggcgcgagttcagaagtactgaggcttggagggcggcggggtgggcgctggacgtggcaaaagctcgaaggggctttccgtagcgcagaccttgttggtggcgatgcgcaggtagtgggcggtggttgcgaggctgcggtgaccgagcagcggctgaatggtgcgcacgtcggcgccggcctccaggagatggacgacgaaggcatgccgcaagctgtgcggtgtcaccggtttcgacaagcgggagagatcgtgtggcttcacgcaggcttgcccaactgcataccgagtaattgggtgaccggcgcgatctccagggaagagccacgcctctggccgccacatcctccaatagtcgcgaaggatctcgaggagcttgggcgacagcatcacatagcggtccttttggcctttaccatgctcgacacgcacaaccattctctggctgtcgatatccgtaggcttcagctgcaccgcttccgaaatgcgcaggccggcggcatagcacgtcgtcaggatggcgtggtgtttgacatcggccacgcagccaagaaagtgctgtacttcatcgggactgaggatgatcggcagcttttgcggtttcttcggaagcggcaatacctcttcaggcgcccagtccctctcgagcgtgacgttgaagaaaaagcgcaacgccgaaagggcgatgtggatcgagccgggcgccaacttcttctcgttggccagatagacctgataggtccgaatatcctcgcggccgagcaagtccggcgccttgccgaagtgtcggggtcatgatgagctcctctgtctgatgggataggctgccaaacagccgtctcatcctctcgcagttggggctcctactgaatacatgacctccttgccgctccgcggtagcggagcgggttagtccaaccctatatatgtgtcggatgagattatgtggcggcgtcgctcgcagttgctgcgtttcccggccgggtgcccgctcggccgccacataatagttccgtctcagatggcctccagcaatcgcagcaaggcatccttcggctggaaccgagccggctggctgccggcaacgcccgccttgtccaagccgcgccgcatcatctcgacgtcggctgccgcgtagcgatgcgtcgtggccacctgcgcgtggcctagccaggcctggatggtcagcaggtccacaccggattgcagaagcgtcatggccagcgtgtgacgcctatgtttctgtcgacataggcgccactatctaccctgccggactatgtcgggtagctttgttcgcaacggtaaatctctgagggataaggatatttcctacagagccgctcagggcacccgacatagtcaacccggttcacaggctgttcaagaaccccaacaaattgtcatcgggtcgaaagcgggatgacttgccggaatatggggaggtctttgccaaggctgcctccttcatcgccaatgtcgcctcgagataaatctgtgtggtctcgacggattcatggccgaggcacaaggcgattacggcccggtctacgcccgcctgcaggaggtccatggccattgtgtgcctcggcctctggcactgggaaacaggatactctggtctccgcgctgcggctcgttcagcgagtttctcaacactgcgattgtagacttggcgaacggagtgcagcgttccccgcgcaggtgggcccccgtgccgaagaacaggcggttggtgtgaggcgaaatcgagcgacgcgcgagttgcgggtaacgttccgcagcggccgagaccgcaagttcaaggcgctgggtgacgtccgaacgtgccatgcgccctccgccccggttcggaaacaggaagttctcctcgcccgcgcagtccaaccggcgtttccagttccggatcaggttggcggtcgtacgccagagcggcacgctgcggtctttgcgccccttgccatgcaggtgcgcgaccgccgagccatcgacgacgacctcgccgacgcgcagaccgatggcttcagacacgcgggcgccggtgttatacatcatgctgaacagcgcgcgtcccgctcacccgcccaggtccgcgcatacggcgcgtcaaagatcgcctgcatcatgatgatctcttgagacgtcgcggcgctccgacgattatccgtgacacgtatccaaggtcgttcacaatccagagaactgccgtcgcggcgccaaaaatcgccgctccaatcgcacttgcaacgacaattctggtcttgccgtcccaaagttctccgaattgtatcaagtccgttaagcgaaagacggcgccctgaactaagtaaagcagcaaagtactttgaccaagctccaccgcaacaaggcgagctaatcgagtcgagcatagaaccctccaacagtgaaacaaagattgcgccgccactgctgcagcggctgcagacccggtgaacatcagcaagacctgtttagccgattgtgcatcatgaactaaaacaagattgttgtaagcgtaagtgtccctcccccaatcaagaaagcacaggcaagccactgcccagcatgagaacatcaaaagagatttgtgacgtagcatggtgttcgcctgctcctcgatcgtctgggcaaacaagaaccccaaacagaagaacggataggtatatctcagcaatggtactatcgataatgtgataggcataagtgcgatcacaattgcagacgcgcacaggatccatttcgataaaaggttgaaagccgcaaagagctttgtgagaaggaaagaagcaagtactgcccacaagaaccaatatgtgccaaccaattcacgtgaaaagtccagaagtccggcagtcacgccgctgaagtgaaaaaacgcggctagcttggctgtttcaataagtgcgcaccaaaacagcattggaatcagtaattgaaccgcacgatcaccgacggcgcgacaaaacgatgttcgcagaattgttccagaagcaagatatccacttatggccataaagaggggcatgtgaaacatatagatcgccttaaaatacggcgacaaccaaaagttatctgtgtttcgatagatcaccaattgtaatagatgacccaatactaccaaaattatgagaatgcctttgacaaaatcaaaggttatatcgcgattgttcgcccctgcggagcacgaaccgcgctccacaggggggactgcggcgtaccccatgaccagctcctaaattttcatccagcgacggttatgcattctcgaatagacgatcgggagacttgggacaggagaaaatcagttgctgctcaacgtccgtctgccaccggcgatgacatctgacttggctccctgcagatccaccagataatcaatcttgtttagattaggccttcggctcaacttagattgcttcttggatggtctactaactgccctcaatgaagtgaccttacaggccggctcttccaatccgctttcttatccgctctttcaaaattggtgcaatcaattgtttggatgaaccgcatttacatgatggattgatatcggactttctaaccgccaacgagtccgccgtgaagacgcgcttggccgcaactgttccggcacaaaagatcgttcaaaatgtaacccggtatgagctcccacgtctccggtgatcagcgggcgcgtgcgtagcggatcggcatccagtattggcgcatggcgtcgacggccgctggaataaaggcgtaggcgttacggagaaagtccccggtctcggagccccttcgtggcggttcgggcagcggacggccccgatcgtcgcgacagtgcagcaggatgggcagaagcaggctgtgattgacgttaccagcgtccagcaacggcgcccacgccggcaacctgagccgcgtcgcggcgtagaatccctgacaccaggggcacggatcaacatcaccatgggtttgcgccggtgcatcggctcgaactggtcgggcgcggtcgtaagacgttgctgatgtcgttatggcgcagcgcgacggcgaagatcgctgcgaactccggggtatcgccgtggttgaaagcatcggcatcgatggcgagcagcgggcagatccagtcgagcggactcatcgacaccggtccggccacgatcgcggcaacgtagccgtcgagcatggcgagactggtggcgataggctgccgatcaacgcgagcctgcagccatcgctcgagttcctcaagcggcatcgcggcggccgccatcgacgacgatgctgatgaatggcgatgtcggcttatgcggcggtctgtgcgatgcgctcgcgggccgccttccagttccaggcgagcagctcgtgcagctgatggtcgtcctggtcatctccgacgaaatctatgaacatggcgagaggattggcgaagatccccgaactccaattcacccctccggacggtgccttctacgccttcatcggcgttggcaatctcattggtcgcaagaccccggacggaaccgttctcgctgatgatacagctatcgcagcctatctcctcaacgaattcggtctgtccagcgttccgggtgctgccttcggctcgccttcgttcatccgcctgtcgattgccgcttcggacgcggaactcgaaagcgcgtgtgaacgtctcgccaagctggttgcgtcgcttagcaaatagcactcgaggactaaggattgcatccgatgaacagatacgaagttgcccttgtcacaggggcctcgagcggtattgggaaggcaatcgcgcttgagcttgcctcggccgggctcagggtccttgctcttggcagggaccgtgctgcgcttgacgagcttcactcgaccgcgggcatcgtgcccgtcgtgttcgatctctctgacgtttccgaagtctatgggaaaatcgcgggggaaaagatcgacgtgctggtgaacaacgccggattactcaccgcctcggcaagcctcgtcgacctgtctgaagacgatattgacgcaatgatcgacatcaacattcggtcggtcttcaagctgacgcggcatgtcctgaagcagatgatcgaacgtcgccgcggccatatctttttcaccggttcaagcggcggccttgcccctcatcccaactcttccgtttacggcgcgacgaaggcggccgtcagcctgttttcatctgcactgcgctgcgatctgatcggtctaccgatcagggtgacggagctttttcccggccgcgttgagacgaacctctatcggacagcgctcggcaaagagggcgcaaagaagaagctctacgacgacaatgaggcgatccagcccgaacacatggcgcgactgctgcgtacggcgctggagttgccggacttcgtcgacgtaacccgcctggaagtgatgccgacgggccaagtagtcggcggcgcccagatgtccaaactttctcgttaactgcgaaccttggaaggaaaagatcatgcagggtatgaacatcgccgtcgtcggtggtgcgagcggcttcggcctcgaaacggcaaagctcatggtccgtgacggcgtgtcgaagatcgtcgtcatcgacatcaatcaggagcgtcttgatgcagcgaagggagagctggccggaaaaggcaccgagattttcacggtcgtccgcgacatcgcacgggcagaaggcgcgcacgcttccttcgacgctgcggtcaagaccgcagggcgcatccgctcgtcaatttgcgcagcgatctatccgcgcgcaccgctgctcgaaatcaccgacgatatgtgggacgctgaaaatgctatcaacatcaagggcacctatcacatgatggtggcggcggtgaagcacatgcagggccacaaggccgagggcgaagtttccggacgcatcgtcaacattacctctgtcgacgctttcaaggcgcacccgcagaacgcacactacgccgcgaccaaggccgcggtcgtcagcttgacccggtcctttgcgcatgcgttcgccaaggatcaggttctgatcaactccgtcgcgccggcgggcatggcgaccgaaaaagccaaatctcttggcttcctcggcgagcttgccgcggccaatccgttgggccgggctgccgaaccagcagaaattgcagaattcgtagtgatggtcgcgggcccgaagaatacatacatgaccggtgaacaagtgatcgtcttgggtggttacatctacgcctgatggcgttcgggtcgcgcctggccttctggcgcgaccccataggaatctagatagcaagaaagtgaaggcggagacgatgggaaacggcttacaggagcgaagcgggggcctgatccttgtccacgccctcaggatccacggtgtggaacgcgtcttcggcgtgcccggcgagggctacctggcggcgcttgacgccttccacgatgccgagcgtgcgatcgagttcgtcatttgccggcaggagggcggggcggcctatggcaaactcaccggcaagccaggcatctgcttcgtcacccgtgggcccggcgccaccaatgcttccgttggtgtgcataccgccttccaggattcaacgccgatgctcctcttcatcagccaggtggcgcgtgaacagacggagcgcgaggcctttcaggagatcgactatcgccggatgttcggccagatggcaaaatgggtagtggagatcgaggatgctgctcgcaccccggaactcgtcagccaggcgttccatcgcgcccgccaatggccggccgggacccgtcgtcatcgcgctgccggaggacatgttgacgaatcgcgtgacggtcgccgatacacccgcttacaagcgcgtcgagacctatgccggtcagccgcaactcgatgagctgaccgaactgctagcgaaagccaagcatccgttggtcgtcgccggtggtggcggctggacgcagcaggctgtcgccgacctgcgttccttctcggaaggtttctcactgccggttgctgcctcgttccgctgtcaggactatttcaacaatatacatgctaattatgccggtgacctcggcattgcggccgggccgaaactgattcgacacatgaaggactgcgacctgctgatcgcaattggcgcccgtctcggcgaaatgacgaccggcgcctattcgctcattgatatcccggtgcggaagcagaccctggtccatattcacccgggcgcagaagagttgggccgcgtttatcacgcgaccctgccgatcaatgccagcgccgtgggcttcctgtcgcaggcgaccgggctcgaaccggctgttgcgccagtctggggtgattggacgaaggctgccgatgccgactatctgaagaaaccgcaggtgcccggccccgtccaaatgggcgaggtgatggcatggctgcgtgctcatctgcctgacgatgccattctgaccatgggagccgggaattacactgcctgggcgcatcgcttctaccagtaccgcacgttccgcacccagctcggccctaccaacggctccatgggctacggcgtgccggccgcgattgcggccaaaattaccgcgccggcgaggacggtcgtggcctttgccggcgacggctgcttcctaatgaacggacaggagctggcgacggccatgcaatacgacgttcgcgtcatcttcctcgtcatcaataatggcatgtacggcacaatccgcatgcaccaggagcggagctatcggggccgcgtttgcggaacgcggcccgcaatcccgacttcgccgatcttgcccgctcctacgggttgcacagcgagactgtgaaggcgaccgaagatttcgtcgacgcctttcgccgctcggaagcctcgggcaagccggcgctaatcgagatccgcatcgatccggaagcgctgacgcccaaccctgacgcagatccgtgaataggcaatcgcgtcggggagatatcagcaagggcggcggcgttactcctccacttcgtctagcattgcgcgaaagcgatccaggatgcgctaccagcgcccgctccgaacgctggtagcgttcgaacagctcagtggagaaatgcccggagcgatcctgcggcaaccgcagttccagtttgccgacccgcgtcatcagcgtccgaccgtagtagccggagcggtagccgagccgctctggcgtgcgctcgcctttccccgcccccagggcctcgtccatctccgcttcgagcacctcctgcatgaccgcgcggactacctcgcgcagcccatccgggttcgaaagcagaatgtctttgaccggagtgctggcggtcttaccttcaatcttggtcatggtagcgttcctcgtgagtgaatcaggtgacttcgacatcaccagcctgccatgaccgcccctcgcagagaatttgcagaaccttcggcacactaccgcggtgttcgtacccgtgactacagtgttccgcgcaatgaacctatcgttgctccgaacgaaacagtgcgaatcgccgtgctgaaggatcggttagctgacccttcatttccccccgagcctttttgattattctttcaggagagcgtaccgaagcacgcgaaggtcttcgtcttcgagtgagatctccaggacccgattgacgagattgtcgtcattgtcgagttcgatcaacgcctgctcaaacagctcgatctgcatgtcgaggtccatgccgggtggccgttaaggcagatcagcccggcatggatggcgacgtcggcatattgccccttggtgcccggcttgtcttttggtccccggaaatcgaccgaattcttcgtgacaaacgtccagtcgccctcaaggatgattggtttaagctcccagtccttcaggccgcccagtttcatccagacgacatggcttgtttcgccgtggcctttttcgatagccatttttgccagttcaggactgagacactcatcgatgagaaacttcatcccgtcttcctgcgacgggcgacgcgacgatctgagacgatgaccgagccttcgggaaggtcgccgaagacgcggcgccggccgcgcaaggggttcgcttccgcgtagattgaggcaagccttatcttttccgcgtccaggctaggccaggcctccagcatgcgctccaccgaatgaccggcagctacggatgcggcaacatcatagaccggaacgcgggtgccccggacgacaggcgtaccgccaaggatgtcgggcgaggatgtgacgatctctcgtgctgcggcaaggtcgtccagtcgttcgctcgcacctctcataaagggcataagatcgatcgtcagaaactcgtggtgcacggtccagtcctcgcgcaacagggcggaccaagggagcgtacgcgctcttgccagtcgaccctctgctatccggatggcaaacagccgctcttccgaggtgagacggcgggcgctctcgaaatagaaggcgatgagggagcaggccccggccaggacatggcgaccgttgtcaagcgacacgaaggcttctggcagaatatgctcatcgatgacgcgattgacgtcgcgtaggctcacgcgcgagacgacggcagcctcgctcgccttcagcatttccgcaactgcgggcatgtgggcctccatataatgctccgatccgtcggaatatataatgtgcaggtggtcatatcaaggtcttgaagacgaatgggtaggcatcgcctgatggtggggcgcgtgcgacactcgatcgaccggcgggaagaggggtcgttttcaccgcccctgatccccgcgccgcaatccaaatggcaatggtgcttgctgttaaatattttgacggggtttcttcaggcagccttcattgtttccgatgcgctgccgctgttctcaccaagatcgaaccggtcgacgagttgcatcaggtagtccgcctcgcccgacagcgtccagctcgcggcttgcgtctcctcggccatggccgcgttgctttgcgtcagctgatcaagccgcgtgattgcaacgttcacctcggcgatcgacgaagcctgctcccggctcgacagcgcgattgcttcgatctgggtcgagatctcgaggatgtgcttggagatatccagcaacgcagcaccggtttcggagacgaggccggcgcccttggcgacttcggccgtggagtttccgattaacgcggcaatctcccgagcagccccggcggaccgctgcgcgagttcccgcacctcctgcgcgaccacggcaaaacctttgccggcctcgccggcgcgcgccgcctcgatgcccgcgttgagcgccagcagattgatctggaatgcgatgtcgtcgatgacctcgatgatgtggccgatatggctggaggcggcctcaatccgccccatggccgcagtcgcattgcccacgaccacggtggagcgatcggcgtcttgcttggccttggagaccgtattgtcggcattggccgcctggtcgcctgccctgcggatggtggcgacgatctcatcaacgcttgcggctgtttcttcgagcgacgcggcctgctgctcggtgcgaccggagagcgccttggcgccctcggccatctgacggccgcttccctggatgacggacgacgtcgtgcggatgtcgaggagggtttgcctgaggcccgcgacggcggcgttgaaatcggtgcgcagtttgtcaagcgccggggcgaagggtgtctcgatcgttgaggtcagccggccctttgccatggcgtcgagcccatctgccagtgcgtcgactgcgaaggcgatttcctggtcgcggcgcaacttttccgcctcgtttcgctcacgctcggcatgggcggcgacgcgctcctgctcggaccgctgttcgagcgcgatcctcgccttcgcattggtcttgaagacgtcgagggcacgcgccatctcgccgatctcgtcggcgcggttccggttagcgacagccgtgtcgagcaggccaccggccagattgcgcatcgtctgggtgatctccccgatcggccccttcagcgtgagcaccagcgccgcgccggaaacgagagcgatgatcacgcccagaaccatggcgccgatggacagcctattggcatcctggctctggcgcccggcggcgctccgttgcaggtcggcgaacagcgatatctgctcgccgatatggtcgatctcgtcggcagcggcctggaattgctgtgtgcgcttgccggtggcgccgacaagttcgacggcggactgttcaatccggtcgaaggaggttgcgagcttggtcgactgctccccggcgaagccgagatcgcccgccgtggagctcagcgcaaagagcgcgttgcggcattgcgcgaggtgcattgccaatgtcgactgcttttctgcggaacggtcgagcatgaattcggcaagtgcgatgcgcgtcaggtagatggcatcggtgagatgccgcgtgtcctgcattacgagcccggccttggcaaccgaggcatcgagctcctcgaaagtcgtcgacacatgctgcatcttcgcggtcgccgccgcctccaacggctccttaagcgctttgagctcagcgaagacatccaggattttctctatgttttccggcgggcgcgccttgtcatccaccagcgcactcaaggccctgacgttggccgaaaaggccttgcccagcggcttggatttcttcggcaacgcgatcggtagcagcttctggtgaatcttcaggtcgcccatggctgcggcgatcgcccgatagccctcgccatcgtccttgcgcgcggcaaatgcatctctgagcgcaacgacaaagcttgtcgcagagaggatcctttgcgcgtcacgcagtttctccttggcgtcgtcttcctgcgtggagatcgacttgtcgaacgcggtggcggcggtcaagagatccgcctgcgatgtcgagatgacccccaaggcctccttgatgccggcttcgaggcgggcttcatcggcatgcagagcccaaaggtcgtccattcggccgttgatcgcagaaagcgccgcggatgcgctttcgagctccgcccagccttcggccttcggcgtcaggcgtgcgccggcagcgtcgagcgcggcgcgctgctcgtcgagcttgctgaagacgagcgcccggttttcttcggtcgtctggtcgagaaagccgatcattgccgcatagacatccttgaagccgcgcagcgatgccgcgacgtcgttggatatcgccatgcggctttgcagaagcccggatgcgagcatgccagtcaccccgaccgcgctgatgctcaggatgaagggcaacaccagcagcatcaccttcgttcggattttgaaacgcgagaggaggcgatcgacccagcccatgagatgtcccgaaattttgttgaggtggcagccgcgtgcagcgcagcatcacggcatcgataggcggcgagggataacaaatcgataatgaagcggcgatcacatgcaaatgtcacaaaacattcacacaagctaatttgtattacttttcaatcgactgggggatactgcaaaccgcgagcaatcctttccgctattgttggaacaccagtcggttcgtcacgtcgctgttgtttccgtgctgtagtttttcgccacagttgaagaggggctaccaatggaaatctccaaatttgcggacgaacaactggccgatcagatcgccgcaggccgcgaggctgtgcccgaagttgatcccatacggttgattgagcaggtcgtccatcgggcgcgcgctggggccggggtggatttcgacgtctttgagtccctgatcggcgaaatcgatctcgtcgaaatcaactatctcgagcgtggtttgatggcatcaagggcggtgtgcaggatcaatgttccggcacccgttggcgacagtagcgactgggggacagggttcttgatcgggccgcggctcttgttgaccaacaatcacgtcatcgactccgctgaagacgctctcaaggctacggtcgaattcggctacgaactcgacgccgaagggcggctgaaacgcacgacacgctttcggctttccccgcaagatggttttgtaacgagcccgagggatgcgctcgattacacggtcgttgcgatcgaggaaaacagcgaggatggcgcgacgccaatctccgacttcggtttcttgcgtctcgacgcgcgcaccggaaagacggaggtcggccagtatgcgaccatcattcaacatcccgatgccaagacgaagcgcatctcgctcagagaaaacaagttcgtcaaatatggggacgaggcggacccggagcgcgacaatttcctctggtactcttccgatacggcaaatggttcgtctggcgcagccgtcttcacggatgcctggcaggtcgtttgcctgcatcacgcaggcgttccagaccgaaggatgatcgatggcaaggaacactgggtgctgaccgacaagacaacggcgcccgctcgcatcgccatcaatctgcccgtcgacaaagttcactggctcgcgaatgaaggcgttcgcatttccaagctcatcgccgacgttcaagagagaattgcggcgccaggctttgcccgttccaccctggtcgatgaccttgttgccgatgcgaccggggtgaaagcctttgccggcacgacgccaggcgagagcatcgtcggcccgccgctcgtcgccgcaccggccctcaggcttgttgccgccgaggcacgacgccggccgacgcggcatacgcacccggccaattatttcgacggacgcgaaggatatcgatcggatttcctgcccgtcgaaatcccgctgcccacactcggggtcaatgcattgcggcatggttcgccggccaaggtcaccggtgcagccgacgacgtcctgcgctaccagcatttctccgtggtcctgaatgccaatcccaagcgcaagatggccttctacaccgccgtgaacatcgacggtgcccgctggacgaacctggaacggggaaatgacgtgtggttttacgacccgcgcatccccgaggaactgcaaaacggcgacgaactctatggcgacgagcctgtgccatcgaagaactatttcgatcgcggtcacctcgtgcgccgcctcgatccggtttggggcgagatccgcgttgccaagcaggccaatgacgacacgttccagtggaccaattgctcgccgcaatattggggcttcaatcagggcgccgatctctggcagggtctggaaaatttcctgctctacaacaccgacgacgagaatgttcaggcttcggtcttctccgggccgctgtttcgcgcggacgatgaagagcacaggggaattctgatcccgcagtttttctggaaggtcattgcggtaaccgacaagaacgacaggctctataccagcggctacatggtcagtcagcaggactatgccctcgacattccgttcgaacgactcccggtcgggccgaacagcacaaaacctggtcaaaatttccaggtcccggtggcaaagattatcgaagacaccggtattgtctttgcagacgagatcttgagcgccgacgcctattccggaccgtcaaccgggcgagcattgcgcaccgtggcggacatacagcatccccggcgctgatcatgcaaagcggctctttgccgcgggctgcatccaaggtttgcgggcgcatcgtgaagccaaacgtcgccagttgcaccgccggcccgttgatcgccgttgaggatctgtcgccctggacatcacgcggcctttgcaaatctggcacgttcgggagggacattcggtttctcgtctgattgcccccgttcacgtctacggttgcgtgtcatagaacagtcataaacggaagcaagcatgctgcgattgccagccttgccgcggggctatgaggtgaagggggacgatcgcttgccatcaagccgcttgcccgaccggaggccgtcgccgtcttgccgcgcaccatcgagcaagctatgagctattccgtcgacgtcgacgtcgacgtcgacgtcgatccggacgggcggtacacattcaatattctggatgagacgcacaggtatccggcatgacgctctgctggaaagatctatacaaacctgctcacggcaactgggtgtgcactgaacggtggcgttgcgaacgggcgaaccgtcatttgaacgaataatcgtcgagccagcggatccccttagacccttaaactatttgttcgttgactcttcgagcgccgcttattcggaagccgagttttttgaaccttaaggcccgcggagcggccgaggtttgcagcggaggactcgcgcaaagatcaaaatccgcaatccaatacggtcaacgatccattcttgacgggtttgccgctcttgaggcggatacatcacccgcgaaagcggcagcctgatcatcggctgccgtctcattaaggagctcggcaagaagcaccggacgcttgtcgcaaacgctcggtcgggcacggatcgaactgcgcacgcacatccgcagcgccgccttccagggctatgtcgtcgtctttcgctacgttgatgagggcatttcgaggacaatttcctcgaggggcacagggatgccggcacggtgttttcccaagagcggcctgtctttggaagatatccgcgacgctctcatcgatgcggccgactgggatttcgtggtcagtcaggcccgttgaactcaacgcattttccgctgacaagtccggtactcaaggcggcgggacagaccggcaagggggtctgtcggctcgccgcatggagtcaatcgcataaatatattcccccaaataatccataaaaactatattttctgtattatactcctgtggcttcctaatgtctatcccgtgaatgcaagcgagaccatccgatgaccaaaacgatacgcttcaacgcttttgaaatgaactgcgtcggccatcagtcgccggggctctggcgccatccgcgcgacaggtcgtggcagtacaaggacctggagtatcggacggatctggcaaaggtgctcgagacgggcttcttcgattccatctttatcgcggacgtgaccgcctattacgacgtctacaagggcaatctcgacaatgccctgctgcagggcgtgcagataccggtcaacgatccgcttcagctcgtcaacccgattgcgcttgcgacgaaccatctcggcatcggcgtcacggcgtcgaccagcttcgagcatccctacaccttcgcgcgccggctttcgacggccgatcaccacaccaaggggcgtatcggctggaatatcgtcacgtcctatcttgaaagcggtgcgaagaacgtcgggcagggcggattgcgttcccatgacaaccgctacgatgtggcatcggatatctcgaagtgctctacaagctcttcgaaggaagttgggaagagggggcggtcgttcgcgacaaggagcgcgggatcttcgccgacccgaccaagattcacgaggtcggtcacaagggaaaatatttcgtgtaggaaagggtgtcaggtcactgatgtggtaattggttccgccggggtattccctgtcgcgactgggcgtgatccggcacggcgcatctcgatgacaagtctgagggtcaaatagacggacactgcggtaaggatgacagcgagaaccggctcaaccaggggatcataggtagggccccaatttgcaagccgatatgtgtcgtcccagggaccggcattgaccggtcttgaccagatatctgcgcagttcacgagcgcgttggatacgtgttggcagacctgcattccgacaacgatgcgccacaagtggattgcagtgagaaggggcaagcagattaagacaacgaacgcgatgccttggacccattttcccggacggcttctgggctcgatatcaaggagcctaaacggaaaggcctccgatgcagaaccggatgacctcttggcgtgatataccgcgagaaaaggaaccagccagaagaagagcgcgaagaagcgcattccatgaacagcataggcttcgcgtgtcaattcgccgtcaaacttaagctcaatcggcagtttgataatcaacgcgaaatcagatttttgcgtcgatccatggatgttgatcatcacgactagcgtgaggatcgccagcgttatccatagctttctgagcgtttcctgcgtcattccggcccctgacacgttaagccttgccgcagatgcggttcagttgttcctgggcccaaccgcgcagcaccggttgcaggagcccaagccctgacaggtattcgcctacgtcacctgaaacgtcgaggtccaaagaggtaatgcgacacgctccaacatcgacagtgacgtctggtgtgacagcacccttcactgaaaaccgaataaatgctgcgtcgcttgtcgcgcaggtgacctccacctttgatctaactcgaaacccttcaggtgctgagcaaatatcgatctgagttgcctcaaatcgccgtgtacggtttggaccctcaggcagagcctcgcaaaccttgatctgctcgatagccgccttgatttttgaccagtcaggtgtgttgagaagtgaccaacattcttccgcttgaaccgttgaggttcctatcaccaggatgagcattccgaataaggcgggcttcaccattggcacgatccccaagccgcacatagaagctgcgttaacacaacatgacgtcggataattttcaactagctgttgaaagattatctcatagcgggtgcactttgtttgaggtttcgaacccggccttatgtgggtccgatgcttggatactaacgtccgaagccaaagacgatttcctcgtcgttttcacgcgctgccacaggagaagacttacgagccgctggatcagctcctaagatcgtcagtgacgggtaacccttccaatccagttcgagttgggcgtcaaaacccctcttctgggccttcgcgaccagattcttaggggcgcttgggtcgtatcccatggtcacgtcagcgagcggatggcgtagatattgaacgctttgcaacgcgagcgtcattgccgcaacaataacagtacggtccgcaaacaagcttccgtcgcgatcgtttgccaaacggaacggaccattctttatcggcgtgtgccctggaacggtgaaatatgcatagcgagaaacgccacggagaaattcgcccgtcgtctggtcgtcgtttccggcgaacgtgggatcgctgccgaccagtatgatatcgatgccgccgtcgccctcatcggacctggaaacatatgcgccttcgatgaacaagcccgattggttatcgacctgcaggcctggctgttcaccgaacatgatgaaagcctgtttcgctggaagcttgatgtcctgagcctccgttttcccgcaagtccagttccatcagatcggcaccaatccttgaaacgtcgaaaatgcaatcatctgacgctaggacatgagctgcaataggctctaggtgtgcaatggtcagcaggcgttcgtcgcgctcttccggcgacataccgctgaactctttcgaaacggcccagtggcgcatgatcgtttcctggcggaatgtgttccgaagctccgatgttgccagagagcccgatatcgtcatgcccaatgcatcgagcctgcggcggaagaccgcctcgaacatggtcgcgcggcacggatgaggatatcgcattgtttttgatcccggatgcattcacacccagcctgatcaaaatctctgcaagcaagaagctcggttcggtgtgggcagtttataacaggaatgaagcccaggcatttgaaatgatgtccccagcaatcttgccaccttcgtcaatttgcagatcgagacctgtcactgtgaagccagtatcctcggcccattcgacgatggcgtttttgcaacctcgaaatcggggacagagtttcgttttgaaagttcgggggaaatcacctacatagccccaaaaacctcagccctaccgctaggctgaagcctgtctcctacgaacggcgatgatgaacccgaagaatttgatcgcggtaggtgatgtgcacggaatggcacaaaccttagaactccttctcaatgaagctgaccgtcacgaaagtgggatgcaccgaagagccggagaatggggaccaaagttcattgttggctcaaggtctccgcgcccctttgtccagccaccgagcaaggcgcattgcccagcgttcgattacccgccgcgcaaggcctcctgccaggttcggatgatgggctgcgtggcagccgtcgcaaagagtgacaagatttgagggttcatcggtcccgcccatagaccgaggcaatagatgatgcacatcggccttcggcggacgtcaccttagtcgagcacgacacgcatctaaagtcatcacgcaggacaacgcggcgcgtttgcttccagttatctgccgggggctgtttggcggctttcttcattgggcgaagaatgggggaaagtcgctgagaaagcgtaaccaatagcaccagtcacagctcattcgaactgaccgcgagacagcgaaattaaaatccccggaggccagcatactttcggcatcgtgatccccggcatcgattgccagaaacttattaatgattgacgcctttgaaatgattacaacagcgctttcaacagctgcactttccgacgtcatcgcggtatcgccggtgtagtagtacagctgaaatacacgcttcttgaagtcgtaatatgttgatatttgagcagaatacagcatcattctgcggctgatttccagatcactatggcttgtttgctgcccacatgatcgctgatgtggtcgaccacgccaaggtcatgggaaatgaacagataagagatgcccatccgcgcctgcaattcccacagaagatccaaaatctgtgcctggatcggcggcgatctgtgaccagtcgatcgaccgcgacgcgaagtgtccgccagaaacggcgcctgtttcagcacgcggaagtgctgcatcttcgcggcgtattcgggggtacaactggccagcttcggcagaggcgtctcctccaatcgcaggaatcgttggttgcgacaaccaacctgcaccggaaccgcgtgcttcggttatgggtatgtcaatccggttcaagaaccgcaccccagcaaaatcaaagacttaaatgcgcaggttcaaatcgcaaaagcttaccccgcaaccaacatggctgagaaaaccgtttgttgaatgggtccggaactgccgccacagttccggaccacggcaacatcgcttcagtgcgatgtgcccgaaccgcccacaggtggcgattcagctcagattagaagtcgcgctgcaggcggacgaagccgctgacgaaatcctccgtgtctgcgccgatgtcgcgacttgtgtactgcacggaaacacgtgacgccaacccagaggtgatcttgtagtcaaccgccagaccaccgcgccattgatccgcatcgctgacgaagccgtaatcaccccaataatgaagccccggggtgatcgcgagcttttcggtggcgttgtagcgatacgaggtggcgacggtccactcggaagcggcgaaatagacgttcgggtcggatgcccagacgccggcaatctggaagacgcccgggccgagttcggccgaaaccagcgcgcggatggctccttcctcgacctcggtatcgtaaccgccgagaaggtcgatcgagacgccgccgaccgtggccgaaacgatgccctgcacgccgatgccgtttgccttcgtggtcgccccttcgagctcattgatggcaacgcctgcctggaacgcgccgccctcatagaggtaggcaatcgagttgaactcggtgatgttcgccagcgagtcagtttcgccgttcaggcctttatcccaccagctgtagaagaaacccgccttgaaaccgccgagctggatataggcctcgtcgaggttgatcaggctgtcaccgacgtcgctgtcgttgtcagcgttgaactcgctggcgaagaagccagtgagcgttccaagttcggtgtcgctctttgcgctgaaggcgatgtatgcgcgcgagaaggcgtcccagtcggacgtgccctgggccccccagccttggcgtttgttgacctcatccgggccaaacgagacctggaaacgagcgtaaccattgatcttcaggcacgtttctgtgccggggatatagaaatagccgatgccgaaagcgtcgcagacgcgaacgtagtccatcggttccggctccgcagcgacgatcgcgtcagccgcttgtgcaccagagactgctgcaagggcaacgctggagccgagaagcacagtgctaaaattcattctcatgcggtcgatctctcttttgggttgggcaagggccggggcaggtcggtcctgaacttcaacggcaccctcgctcgcgctgcggcgaaacgggccgtcaatattgacgggcagcgcgctacctttaccaacgaatatattcatattctaaaggtatatgaattccgtaaggcgacgaaatgaaagtggtagacattcgttgttaacgcaacacgtaaatattgtcgcattttgtacagcgcaaaagactgggcaatgttactaatcatacaaatagtttgtatgatggcgccgaattggcgcgtaataaaacttgaaacaacttgacatataagaaactgatgatagatatatatcgcccgatgagaagagggctcttcccgactagcgccgccagagcctccagcctggcggcgcatttcatctcgacgctatgggcgttttcccaggcgctctataccggtggcgacacggctttcatggccgtcggactttgcctcgcaggataatggggaaggatcgcccgcctacagcgccgtgcgtccttcaggacgcacaaaggcgctgtaagtcttcgaatctacccattgtgctttccgaaaatcggttccgattttcgggccgatgcgctagggcaaaccgtcgagtgcggtccaggaatgtcgggacgctgtccgtttttagtggcagagcgctccccggggccaagcgctgcttgggtctgtcgcccttggactaggcctgctcgacggagccctcgttacgggtgaaacgaagggcggacgaggggctgagaccgtaggcgctcttatagagaaccgagaaccggcccggattggaaaactgaagattcaaggccagctcggtaatgctgcccgcccggccggccttgatggcgccatgggcggcggcgagcctatagttgcagaggacgctcatgggcgagcctcctcgataggtgcggaacatcctctggagcgcccgcggcgtgcaccgggcagcggcggcgaggtcctcgatcgtaacagggttggtcaggttctcgcgcatgaacgcctcagctttaaggagctgtcttggtgccgcaccgctggttccctgacagaatgcctcagcgagattgtgcggcatcgtcgagaacaactttacgagggccagctgcttgtacgcctttgccaacaaaggcatggctttcgatgctgccgagttgagatccctttccgcctgccggagcgtctgatacagaccttgaacgtcatcttgagaaaagcaggtagccggcaatacgaactcgtgcacatagggtctaccggtcaggtcctcgaagcttcgcctgagagccgactcgggaatatggaaggccaaccacgaactttcagattggatcgtcattcggttgccggcacgttcgcgggcgctcgcgacatgattaggcgagatgcttagtgttttgcgtgtccgccggtcggtgatttcgatatgtccggacagcacgaaatagaagctgatgagccgcgtatcgcgcctggcaagcgcttgcagacagaccgaatgctccgcgcttgccagccaggctgacagaactcgttgccggtggtaggcgagcgagcaagcctccggggtctctgaggagaccttccacctccagttcggctcgacagatccaagattggcgaggatcgtgtcgcgcgtatgggcgacgaaactgtctgtccgcagtggctcgtctgtgctgggaagggttgcgcaaaaaagcacggtgttccagccgaggctcggaaacttgtctaggagaggcagcgaaccgcattgacgaaccaatggttccgccgccgcgatcaggttccagtcgagcatcgaaaacagcgccaatgggttgagaggcgggtagagcagaacggctatcaaagcagcaatcgtcccagcgacgagcaggcacaggaccagcttgccgaacggcaagggcatcacttggtggctcgttttatcagcagagccatgacgcgcgtcaatctgcactgctctccatcctgtgcgatattcgatctgaacccggatcgaagatgtgtttttcggatagggatcgcgcgtcggctttggccgttactctgagatgctgcggagcggcaatgatggcgactttcccatctgcctcgaagagaatggacgaaggcgcaccggctgcgcgacacaagacatgtccggccgcacaatcccaaagatgggtgccgtgctcgacatagccggcaagccgacccgccgcgaccatcgcaagtgctgcggcacagcttccaaggcagacgatatgataaccgcgcgcctcaaacgcggcctcgacttcgaggcgatgggcgaggggccatgttcggttgcggcctatgccaaaggcgatcggctgcgccccgacaagcggcgaaaccgagcctgtcccatgcaatgggccatccacagaagcccacaacagagtatcgagtgccggtagcgcaacagcgccgaggaccggctccttgttgcggacaaaagcgatagagaccgcccagagcggtatgcccgacaggaaattcgcggtcccatcgatcggatcgatcaaccaatggtcaacttcggcatcgccaagctgttcctcgccgacgatcgcgtcggcggggaactgggcgtggatcagcctgcgggcaagactttcggcgtcacgatcggctgcgctgacgtagtcggcctcacccttggtctcgatgacgatgtgggaaagattgccaaaccgggccagcgcgaaggctccaaccttgctggtgatgttccgaagcaaatcgagccgagtgtcgaggtcgcttgtcaatttgccgcccgatcccgcgccgacgcaaccatctcttcaagccgcagagcgatagcgtgtgcccgctgatagtaggacgactccgacagcacgtagcggtccatcggcgtctcgaagttcaagggcgtcctgtaatttgttgccgcaatggcttttgtgatcgcatcccagtcaagcctgccgtcgaatggcagcagatggtcgtcctttgcgccgaagttgtcatgaatatgcgtggcgatcagccgatcgccatggcgctccagcaccgacagcttgccgggctcgatcagttcccaatggccgctgtcgtagcagacgccaacgaagtcggaactgtagcggctaaagaggcgggcatagagcttgaggtaattttccgcatttgccttgaccagggtttcgaccgcgatctgcacgttgcgttcgatgcaatgggcctcgacgtcgtcgaaggatcggaacaggggctcgaacaacaggttctcgttttcaacgctgcggaacgtgtcgtcggtgatgtcgacgtggagcacgacattcggagcgccgagggccgcagcgagatcgatacggttttttagaagctccaccccgctttgacgctgccaatcgtggtgagagaggaagttcttgcgtgtctcctgcgcgaatgggacaggtccggcatgggcgagctcgctcaccgggttgacgccgttgctggcatgaacggagtgtgtttgcaggcccgcctccgcaacgatgcggcgggtgaactcgatttcggcgtcggcaagcatataggagctgccggaatcggggttccagttgatatgcgtaaatccggcttcacggatcaggtcgagggagtggcggatgccctcgtcgtaccagcgttcatgggtgggccaatgccagacggtgatgcaagtatccatttcagtgtccattcagaggttgctcgattccggggtgcggccgaggctcaggcgctcggcgatgaggatgacggccagcgagaaggccatgatcagggtcacgtagacgagactgacggcggcctggtcgggatcggccgaaactgcgccatcgacgatggcgatcggcagaggcttgttgttgacgttgtaaaggaaggccgagagcgggtattccgccagcagattgttgaacttcatgccggcgaccaggattgcggtcggcgccacgagcggcaggacaacacggcggagccgatacggccccgaggcgcccattgcccgggccgcttcgtcgaaggccggatcgatcccgatgaaggccgagcgcatgaagcggaccatgagcggcaggctgaagatgacgtagccgatcggcaaaagccaatagctgccgagcagaacgagattgccgacgagcggattgggcgcatcgaaagcaacgatcagccctacggcaagcagcatggtggggatgatccaaggcaggacaaagcagatatccaggcctcgcgtcagccagttgcgcttgcgcaccatgatcggcacggcaaacaaagtgatggcgaggccgacggcaaccgcgatcgagctcatcaacatcgaattgaagaaggggacaaaggccgcgccgccgcccagcacccgagcgtagtttgccagcgtgaagctggaaggcaggacgtcgatgccgatgctcgaagccggggcgaaggagaacagcacaatgagcgcgaccggcatcaggtagatcgctgccagcaaataggccagcgcggtcaccacgatacgggcaagcggattgcgtatcgcccgcaactggatgcgtgttgtcgccttagcgccggccgtataggcgcccttggcctcgaaatactgcgacagcaggatcagccccatgagcacaagccccatcaacagcgccagcagcgccgccatgtctggccggcgcaagctgttcagcgtcaggaccatctggctcagcatgtggaagtcccggccgccgagcacctggggcgcggcaaaggaacccatcgccgtaatcagcgtgagcagcgtaaccgcgagcacggttggcaggatgaccggcaggacgacgcaccgcagaatcgtcatttccgaggctcccatgctacgggccgcctcgatcgtcgaatagtcgacgcggcgcatggcggcgcgcagaaacaggaagtgaaagctggtcatcagaaaagtgtgggcgaagagaaccccaaaccagccgatgaaccaatcgcgcggcagcgacgggaagagcgcggccaaagcagcagtgatggcaccgctcggaccataggtgaagttgtagccggcagccgcaacgacgccgccgaagacgagcggcgtggagaaggcgattttcagaaagccacgccccggcacgcgaaaatactcgagcaccgccacctggaacataccgacgatcgtgacggtgagggtggtcgccgccgtcatccaaaccgtgttccaaagcgctgcgcggacgcggcgagagcgtgcgagttccgataccgcatcaaacatggccaaactgccgagcctgaacaacgcggcctgcaaggcagcaagcatcggaacgagaaggaaggtcagcacggcccaggcaatcacgatcaagccgagccagtaaaaaacacggtccaggcgggtggatcggctcatccggtcacctcctggaacacatgcgcggcgccggggcgaattccgagcgagacggtactgccgggttcaggaagctggtcgccgatcagcattgccgaaagcgcatgaccctcgacctcgagatcgacgcggctatgggctccgaggaattcgacgtggttcactcgcgccggaacgccggcgaccgccccaagcaggacgtcttcatggcgcaggaagctgcggcctttgacatcgtatcccagcaggcgcgccgcgagtggcggagcaagttcgttggagacgccgatgaactcgcatatgaacggagtcgccggcttgcggtagagggtacgaccatcgccgatctgctcgatcttgccgtgattgagcaccacgatgaggtcggacatggtcagcgcgtcctcctggtcgtgcgtgacgaagatggcggtaaagccgagctccgactgaaggcgcttgatttccttgcgcatcgcggcgcgcaccttcgcatcaagatttgacaacggctcgtcgaagagcagcacgcgtgatcccgtgacgagcgcgcgagcaatggcgacgcgctgttgctggccgcccgacatgttcgctggcttcttgtcgagctgatcggaaataccggccatctcggcaacctcgccgacgcgcctttccacctccgccttggacttcttcgccacgcgcagcgcaaaggcgatgttctcgaacgccgacatcgtcggaaacagcgcgtagttctgaaagacgatgccgacgttgcggcgctcgggcggaagggcggtaatgtcttgcccctctaggagcacccttccgcccaaagccgggagcaacccggcaatggtgcgcaacacgctggattttccgctccccgacgggccgaggagcgacacgaacgccccgtcggccacgtcgaggttcaggtcacggacaacggtcatgccagggaagccgacgtcgagtttgttgagggacagaacgctgtcagccatggctctagacctccgatccatgcagagccgcgctcattgacggatttcaagctcgatcttctgcagccagctgtcgagctttggagcgattgcatcccaatcgatcggctgggtgttgacgagcttggcattcgcctgaacggtggccggcgacttggcgagcgcttccggcaggacagggacctggccgaacttggcggcgtatgcggccatcacatcggccgatccccaccagtcgacgaaggccttggcctcatcgagttgatcggtcccggccatgatcgccacaccttcggaaatcaccggagtgccgccgtcggtgtcgatcacctggactttcgcgtcgaggtcatcggcccgcttcaaagcgccgccgagccaattcagatcgatggaggcgcgaccggacttgaacgcctcgagctgggaatccgcatcgttggcgataatgccctcagcataaaacctgtccaggaaatcccatccctcatcggatacctcaccatcggcgtcgaggaaacggacgaggatgccggcaagatacatgcgggtcgtctgggccgccgtggagccgatgacatatttgccctcataatcgtccttcgtcagatccagccagcttttcggcgcgtctgggtcggccagtcggtcggggtagtacgcgagcacgatcggcgtctgccagaacttgtggaccaggccttccgcgtccttatattgtgccggaaggtccttggcccaggacggcgaatagggctggaagaggccttccttctttaagagggccatcgaggtgtctaccatcccgagaacgacgtcggcttgcgggttgttctcctcggcgatcaggcgatcgtagagttcgccgccccctgcgttcagtagcttaatctcatgacccgctgccttggcctgttcagcgatccatgccccgcgctcaccgccttgcgggctgtagacggtcagtgtgtcggccagcgctggaaaggccgcggccacgacgatggcggcggtcgcaaatgcaaatgccagtttcatgatgttctctcccttatcgagcgacgcgctcctcttacgccggctccatgtcagtttaattacattgcgcaatttaattttccttgcaatagctttcctgaaacttcgaccgatttgcggactttgccatgcctgttttgcccgagctctccctcaatgaacgacgcctcgtcgagttgatcttcaagaacaggggcgtggctcgcatcgagttggcgcagatgtccgggatgaccggcgccaccgtgacgcgtctggttgcgagtttgctggatctcggcctgatcaccgaggaggcggatcgaagcggagcgcaaggccagccacgccggttgctgcagctccaggcccgccgtttctttgccgccggcgtcaccttttcggtgacccgcatggaagtcgtcattatcgatctcagcggctcgatcgtggcaacgagaagcgtggaggttcatacggcaagtccaatggaagtggtggaggcggctcaggctgccgtcgatgacatgctcgccgccttatccatccagaagaacgaccttgtcggaattggcgtttccgttccgggaaattttggcaccgcctcgaacctgttgaaagcccatcccttctttcctgcgttcgaagacggccaggcgatcgaagcgttccgtgaggcgttcgacgtcccatgccatgtcgaaaacgacggcacggctgccgcacttggcgaatacgtgttcgcgggtgacaacgtgctggatgatccgctgttcttcatccacatcggccatggcgtcggcggcggcgcggtgatcgacggcagaccttatggcggcgcgcacggcaatgcttgcctgccgggtgtcctctatccctacgatcagccgcggccgtccgggcaggaccttctcgcgacgttgcacgcggccggtttccatcttcgagatttcgaggagatggacgcgatgcctcaggccgctcgctccaccgttatcgaatggatcacgcgcgctggcgcgcagctccggcaagccgtccgtgtcgcaacagcatttttcgatcccgcgcgtattgtcgtaggtgggcggttacccggcgatctgaataaaaggcttgttgaaacgatcctgtctgagccgatagaaggaccatcgcgaggtctgccgaccgctccggtttccgtatctcgacttggcattcgcgccggcgccgttggtgccggctgtgttccgttcttcagagcattttttacgggtgccgtcgccaatggtggaagcgcctacctgaacggtagacgaccttttcctcggactcccgcccaatagttccgtgccggaacacgcaacgctaccacagccccaagctgtgcagccggaagctgttgcacatgaggccgactcgtcaggaaatcccgcgcaagacatgtcgagaccactgcagacccgccccttgagcagggagcttcacatgtccgagctgaggatattctcatcgtcagaccaatcggcgccggcaggttattcccttacagcgccgcgcgtcttatcggacgcgcaaaggtcgctgtagcgctttgaattgctgcatgtttttccttgagccgaggttgattcaaagagacatgcagtagagtgacctttgagcagcattccaacaggcgaaggctgtcgcatgtctaactgtgtgtagcatctctaaaatgcttcactccaaaaaattgggacctcgatcggggttccaccggcgcatcaggacccttccgaaaatcgtcagtttattgacagctaagccttgtagaagattcggcgcttccgggattttgcagccgccctccatgattgcctgcttcggcagtggtcggtgatcaccgtcgattttgagagctcctgcttctcaaagcactcggcgcaatccttcatattgttaccgaggagacaatatcgatgaatgtacaacggcccggacttgccgtgggcccccttttcgagaatcccgaatcagaaagttcagaaccagggtctccggccgccgccgcacgttgggtcgaagcctctacggaggcggaggcgtccgccgcctcctcgtcgcaaggccagatcgtggcagccccgaccgccgaagaacggccatgggagggtcgtccgcaagaggcggtaagtcgaacgagggcctggcgggaggcgggcgatgtcgatgagccgctggatctgtcgttcctatccctgacccccttgtccatccccctcgtatccgggctccggcgcctgaacgtcaacaacaatcagctaggggatctgccagacaccctcccgggaacgcttctggagctggaggccagcgagaaccggctgacccgcctgcccgaccttcctgccgggctccagaggctgaacgtcgaaaacaaccggctgaccaatctccccgagcccctcccggccgcgctcgagtggctgggtgctggctacaaccagctaacccgcctgcccgagatgattccccccgagcttatatggctgggcgccagaaacaatcagctgaccagcgtgcccgaaagcctgctgacgcagctaggccaatggtctagcattgatttggaaaataatccgctgccgcatggggtacaaacaaacttggtgacagccatgcatgccgcgggttacgcaggaccgcagatctttttgcctatgggaccggtggaacttgcacgacggccccttcacgaggttgtcgcggattggctcgagggggatttggaaacggtggccgcctggcggggcttcgccaacgaacaaggtgcccgggattatgcacatttcctcgaccggctccgtaccaccgtgaactatggcaatgatgcgttccggcaggcggtggccataggtctgcggcaggcagtggccaggccgcaattgcgcgcacagtattttgagcaggcttccggagctagcgatagctgtgaggatcgcattactttgacctggaatggaatgcagaccgcacttctgatcgctgatgtagaggacggggtctatgacgggtcgctccaccagcttctccagcacggccgtgtcatgttccgtttggaggcactggacgggatcgcgcgcgagacggtcaactcgcttcgacgtaccgatccggacgccgacatcgacgagatcgaggtctatcttgcctaccagacacagctgcgcgacaccctggagctgcggcacgtcgccccagacatgcgcttcttgaacgtctctcacgttaccgaggaggacgttgccagagctgccagttccgtgcgggaacttgaggcgaggggattcggcgagtatgtggcaacgcgctggcaaccttgggaaagagtcatgaggcgcatcgcccccgcaagccatgcagcgatgcaggagcagctcatcgaagcgatgggagaggagttcagaagccgcttggacgaaaagctcgccgagcacggcctgacgggtgatgccgatgccgaacgggtattcggagccgagatcctcaacgacatcgcccgcaggatcaaaggcgagacaatggagaaggtgcttcggggtcgcggtcttgagctgtgaagcggccgtccatgcggtggctgtcaattgctgttcctgcggcggtcgcccgcgtctattgcgcgaccgagatcaggttatgccaggccggtagcaacggcgccagcgacggtgaattggtgcgcgtgggaaaccaccaaagccgttctggccgggacggacattgcaggtgttgcgggcgtcacggaatgcgttttcaaatgaaaagctcgagtcattgtagttttctaactcccgccattagaccgcccgcccactcgccggccgtccctgcccagtcggtaccattcaaggatacggtttacgaccatcgagtggcgcagatcgtgaacgcgtgggccggctttgcctttcaacccggcacgacgtatgacgtctgtaagcaaccaggtgatccttcctggcgtggagcgggaactgccttgttcgtgccagaacagggcggagtgaggagcctgctatgcgccgacccgacgccgtgcaacgatataggtccgaagctaaccactacactgtcgggaagcggcaggatccgggtcttgaagaactttgtttgccgaaccgtgatggtgccgtcgccgaggttaacgtcaccaagatcaagtctggccaattcgcctcgccgcagacccgcgcaataagccagcaacagcatggtatacatgttctcctggcgaagtgcagctcgcggcgatggataggatcgcgcaatgtcgagcatccgtctcaagtcggcaggtgagtagatatggggctttcgccattgcctggccacctccttccggggtctcggatccgaccggcgcggagggaccgacgggtcacgatgccgtaggattttcgcgaaggcgcgctcgagtttttcgcgctcgtacgcatggttgcgcgtgcccttcgttgccgcccactgacacacactcagcggctcggtttccagttacgggttcagctgcaggaaccgatcgaactgcaagaacaacaccggttgcgacgtatacttgtatcccctgcgacgcatcatcgcgacatgctcagccatgatcccgcccagcgctgccgaacggttcgggctgacgcagttgggcaagagcctgttctggatcacatgatatcaatgcgcgccagactggcatgcactgtttgatgtggcatgcctcacgcaaatcttcgacgggattgtgatcaatcgcagccgcttccaagaagtggtcgaggaaccgatcgataatgcgggtccgatgtagcagtgtcgtcgcagcccaacggtcagacgactgccgcaaccaggccagtagcacctgttggtcgagtgcctcgtgacgttcgacaacgtcctggaagccatgcaggacttgacggtaacaagtccggcttttgatactgcgcagatcaaggctcgcgacatagcggccaatgtacgcgcgatcgggatcgggccaacgggcggtcatgccgacacctccgttcccggcaaatcaagagcgatggccctgagatcctcggtcgcaagcttgaggtagggcgccgtcgacgcaatcgatcgatgccccaacaactcaccgatgatcttttgtggcaccgcggcgcgcaacagttcggtcgcgcgcgcgtggcggaagatatgaggcccacgcttgccccggggtttgacgccagcgtcacgtagccgccgtcgaaccatgctgtatagcttgtcgagcttgcgatagggtgcacgcgtgcgaacgaagagttctctcgcatctgtcgcgggccgtccggaacgcagataaacaaggattgcttcgccaaccggctccgtcaagggaaggagcgtgtaggcttgcgttttgctgtgacggacacgaatggtttcggtccgccaatcgatatcctcaatccgcatgttgcggatttctcctgatcgcagtccgtaggtggcgagcagttgtaatatcgcatggtcccgcaagccggccggcgttttgtccctgctcgcacttaccagaaccgctgcgatttggtcccgctccaaaatggaaggcacgccttcataggcgtaaagccgcggcgccagaacatgcggcgacaggtccgttccaatgagccttgtccgatggagataacgcagcagcgagtgaagccgctacgctgcgcatttcagcgaactgcgcgtcagtttcgaggcaagcatgtccacatagcggtcgatgtcgccgacgctcacttccatgaggccttcggctccgcatcgttccagttgccagcccaggaagtgtctggcctcccacaagaacgcgtcgatgctcgcccgagcaagaccacgctcctcgcgaagccaggtttcgtattcgttgcagatcgcaaaccgcagtgcgtcggcggcgcaggttacttttggagcaggtggccaccgatcctgcacaagtcgcagcagtgcgtcacagatatcgcgctacctcggcttcggtcacatctgcgaccagaattcctcgctgcattaaataatcgagaaactcctgtgcataggcgcagtaatttccgatcaccaccggactatatcggtgactgctcagtatggctttgagttcagtgattagttctcgttcagatttcgacatcaatagctcctctgctggtcgaatgaccgcagaggttcgctggaaaataatacagagcaaagacggcgacaaacagcagaattgtattcattttctgcgccggtcccgcgctccttcgcattatggtcacctgatgattagtcaaacgggggaagacggatgcagccgacgctgaggcgattagtgaggcagtgacgcgcaagacgatgcgcttcgttccggtgaaaatcccccgaacagcaggcggcggcgatggtattgaagacacgtgcccttctggttcgtcagcaaactcagacaatcaacgcgctacgtgctcacctgtccgaactgaggatcattgccggcatcggcacggtgaaaattgcaagcctgatctcgccgataaagacgagccgcttcggatcgaagcggtcttgccaggccttccagcgggctctgcgccgtgcaatcccgcaacgattccgataggaaatgatccgctctcgtttttccaagtccggccctcaacggaaccaccggggccctcaagccgatctgttggaatgcattcgttcgcatattccatggtttgaataggccccatacaaaaaatggattttcccagtcttgccacatggtgcatagcgaagctccccacgcgtgcctcgcctacgccacctttcgttggggcatgacaccacgacaatagagaaaggctgatagatgaagaacgtcacatacctcttggacccggagtctttcgcactattgggattgccgacggtgtcggcctcgcgccgatctttggtttgctcggttttgccgcctagtgcagatgatccgctttgacgattcgcatgcgctattcttagatgaagaagtaccgcgcgatggggaacagcgttcacggtttttgcctaggccggtggaacacgaaggtaagggcacttgtctgccgcgcctgccagacaatcggaaccgaaaacacggtccaccgctattgcacgcctcttactgccgcccatgttgcaaatttaacccgaattttcggaggtatatctcatgaatcgtaggaccgtgctgatgctcgcatgcaccgcagcagtcgccacatggctcgtagcctcgccggacgtgcgggcggaccccgttgcggatatatgttaccttttttgcccagcggagcaggatgacaccgtcggcgcgttttgttcatctttttgctcctcatcttcgtcccttccgcttccaacggaccctcagagcggaagccaggtagagagtcaaaatccgactcgaaccacagacactgcgagccgaacgtcagagaagccgtgacaggagtagtacaattcaggccttggcggatcgtctgggtctcgaaaaaacgctctccagttgcagagccgctgtcaaagatcggtaacacgttagcgattgtttcggcgagcgatgtggctcgacgcgcatcgcgatctggttggcttaatggcgcgagacctgtgtcggcacagcggtcaaggtaaccgggcgccaaggcctgcctgcggaggaggtcctgggctgcgctgctaatgtcgcttggcacgtaaatgtgagaatgcggctgtttcagctgggcttagcatttaaagcgggtcttcctcactttgtgtggttcactcgccgttagacatcctgccgctatgggatgcaaaccaaatcgaaatggtcgcccggcccaggggcaaaagttttgggtgtcgcgctcaccgatgatgacagttgggttgtttgcgctgccggaccagcgttcggcatttgcccccccctgattgcggacggcggacccgaaatcggccggctggaccccagaagcctgcaagatctgccggtccagggcaagaccgtaacggtgaagcttcggttgagccgctggcggtgcgcacatcagaactgtcagcgacaaacgttcaccgactgactgccgacgattgcttccccttatgcgcgccggacaaggagggtctctgagattgtcggtctgctcggtcatagtgcaggcgccgtcccggcgagcgcttgatgcgaaggctcggcatgccgtccgcgacgacacgatcctgcggcagctgaagcgggatgccgcgccgcgctcgctcattgcgacgccgcaagcgcgtcaggtggctgatcgattccatctttatgcagatctgcgggttgcaatcgaggagcagatgagcctttccggccgtgccaggggacgagcattgctgccggacaaaatcatcgggaacgcgcaagtcgatctgattcaggatgatcctcacgttgacgcaacgcatcggcgccgggtgcgtcacggtcatcgacaatcacggcaggtggtgttcgagactgtgcacgccttgcgcaagaaaggtctgtcctgttcggcgatcgcacgtcgcaccggctacggccggcgcagcatcgcaaaatggctgactttcgagacgccacccgaccgacggaagtcggtgttgaagccgacatcacccataaaagatggcaatcgctgcggacggcatctgtacacgatatcaaacagcgcggttacatcggcagtttctcgaatctcgagcgacttctcgcagcctggcgccgcgccgagaggtcgagcaaggacagtgcgtcgccggctcctatcatacccgatcaaccggctcgcgatgttgtcccgatgcgggatccggagactggccacgtgatctcgccggtggtcgcagctgccctctgcatgaggccgcgaagcatgctgacgatcaatcaggcgagcaaggtggacgccctgaagcagcgatcacatgagtttgtcctgatgcgcagccttgccatgcgatttctggggcaacggccaggcagaaggccagatcgaccgcctgaagacgatcaaacgtgcaatcgatggcagagcaggcgcggagctcctgagagcacacatgctgccgctcgacaatactcatcaccacacagagtggccccacacccttgaggagatggtccttttacgccgtgcatcacggtttatcaggcaccggctatgtgcgctacgacgaccgacttaattatcggcggcacgcttcggagctcggcgagggagacattcactttggcaagggccaagacggcaatgccattccgctcagccgccggccagcatccagcggatcgatagataagcaccccgaaaactacctcgccgcagtatacccgtcgcctatggatgtcctaaataggagagttcgtcagcttttcgaaagctcagccgaatagcagtgggaaggccaagaccgaccaacctacctgaattcagaaatgggcctccatccaaatttcgcaatgcattacttcaagcaaaatctcgtgccgcggaggcagtcgtcacctgaggcgttaaccgaccaagtggagctctgccccagcgagccacataactcgcatgcagctcttcactgccgaaactcctcagacgccagtaaaccctgctacccggcaaggacgagtatctccccgtgcggatacagggcggccgaattgctttatacgaatgcaaacgacatctgcgccgggccgactgcggggtggctcctgaatctcaataacagcgcgccgccccgaacgaacgcgctatccgcggcgaggagtctgcacctgcgcaccacagcgagaagttcatgcgcattttggtgactggtggcgccggctttatcggatcagcgctggttcggtatctcgtgagcatcaacgcggaggtcctgaacgttgacaagttgacctacgctggcaacctcgcttcgctgaagccggtcgaaggtctccgcaactatcggttccttcgcgccgatatctgcgaccgagtggcgataaacgaagctttcgagacgtttcagccggattacgtcattcatctggcggcggaaagtcacgtagatcgctcgatcaccggagcggacgacttcgtccagactaacgtgaacggaactttcacaatgctggagacagcgcggcaatactggagcaatctgtcccagaatcggaaggcattctttaagatgctgcatgtgtcgaccgacgaggtttatggctcacttggagaccgcggtcagttcgaggaggtttcaccgtacgacccatcttctccctactcggcttcaaaggcggcgagcgaccattttgcaaccgcatggcagcgaacatatgggcttcccgtggtcatttcgaattgctccaacaactatggaccgttccacttccccgagaaactgatcccgctgatgattctcaatgcattggataggaagcctttgcccgtctatgggacgggttccaacattcgcgattggctctatgtcgacgaccatgcccgagccctttggctgatcgtcagggaaggccgtcctggtgagaaatacaatgtcggaggtcgcaacgagttgcgcaatatcgacgtcgtcaaccgcatatgcttgctcctcgatgagcttagtcccaacgcttcgcactatggtgacctaattactttcgtgaaagacaggccgggtcacgacgcacgctacgccattgacgccacgaagctcgaaaccgagcttggctggaaggcgcaggagaatttcgataccggcatacgcaaaacggtggaatggtatctggaaaatggctggtggtggcaaccgctgcgggacaaggtttattccggtgagcgcctcggtctcctggagaaagcgtgacagatgcggctcgcggtgaccggcaaaaacggacaaatcgccctcgctttgaaggcgcaggcgcgacctgacgtcgagatacttactttggggcggccgaatttcgatctggcttgccgctcgactgtcgcaagctccatcagggatgccgcaccggacataattgtctctttggccgcctataccgccgtcgataaggccgaaagcgagccatacgaagccttcgctgtgaaccgcgatggagtgcaggcactggccgaggcagccgccgggctcggtgtcccagttattcatctttcgacagattacgtgtttgacggtgcgaagccggtgccttactgcgaggaagaccgcacaggcccgatttcagtttatggcaggtccaaacttgagggtgaatttgcggttgcctccgccaacccaaatcatacgatcctgcgcacttcatgggtctattctcgatacggccaaaacttcgtgaagaagatgctccggctcgccgatacgaatgacgaattgaatgtcgtcgccgatcagctcggctgtccgacatcggctgacgacatcagcgtcgccgtcatgacgatagccagacggatgctgtcgagctcatcggctgatttgcgcgggatattccacctgtcaggatcgggtgaggccagctgggcggccttcgcgaaatacgtcttttccgtttacgacgagataaccgggcgccaaatcaaagtccatgacatatccgctgcagaatatcccacaccggctcgccgcccagcaaattcgaggctccactgcgacaagcttgagcgaacctttggtatccgtctgccaaattgggaggagtccacgcgccggctggtttgggcgctgcttttagaagggaaagatgcgtgaagggaattattctagcaggtggcagcggtacgcgccttcacccgatgacgcttgtcatgtcaaagcaaatcttacctgtctacgacaagccgatgatcttttatccgctgaccacgttaatgttggccggaatccgcgaaatcctcatcatctccacgccgcaccacatgcctctcttccaggcattgctgggggacggttcgcaatgggggatctccttaagatatgctgttcagcccagcccgaacgggctggcgcaggcctatgtaatcggtgccgatttcgtagctggttcaccctcttgcctgatcctcggcgacaacatttatttcggccacggcttgcagggacttttgcagcaagcggccgccctccagcaaggagccacaatttttgcctatcatgtcaacgatccggagcgctatggcgtcgttgagttcgatgagggcatgaacgcgctctcgatcgaggagaagcctgcggcaccgaaatcgacctgggccgtcacgggactttatttctacgattccgaagttgttgacatcgccgccaatctcaaaccttcagcgcgtggcgaatatgaaatcaccgacgtcaacagaatttatctagagcgtgggaaattgaaggttgctgttttggggcgcgggtacgcttggctcgatactggtactcccgacagtttgctcgaggctgcagagtttgtgcgcacactcgagaagcggcaagcattcaaagttgcctgcccggaggaagtcgctctggcaatgggcttcatctcagtagaagaatttgcgcgaattgcggagagggccggaaagggagattacggcgcctatcttcggcggcttgcgtgaagcgccgcgtgatcaagatggcaacaagggctagcgacatgcatcttctgaacgttccgctcagtcagccgcacttctttgacccccacagtgcgtggctgcgacatggcccctttgggatgtggctggttcacgcgttgcggccgcggcgaattgtggaactgggcacgcattacggcttttcctacttttgtttttgtcaggcggtggccgcgggtgatctggcgactgagtgttttgcggtcgatacatggcagggcgacgagcatgctgggttttacggcgaagagatctatcatcgcgtgatggcccacaatcagcaatacgtcaggttcagcaggcttttgcgcaagaccttcaccgaggcgctggacgacatcgaggacagttccgttgatctgctgcatgttgatggtcgccacttttaccacgacgtaaaagcggatttcgaaaactggattcctaagctgtcgccccgctcagttgtgctgttccatgacactgaagtccgcgagcacgggttcggtgtttggcaatactgggcggaactcgcagccatccgtccatcgttgaacttcccctatcagcatgggctgggaatgctgttctggggcaaagaaattgcggaggggctcgcgccattggcgcggacgcttaccgacacagaacggctcaattggccggtcgagtactttgccttggcaggtgaaagctatgtgcgcgacgccacgcaacggggagtcataaaaaggttagaattggcggaagcgaccatcgaggagcgtaaagccgagaccgtgttggtgcaacagaagctgcaggaagcgcgccgccgaccgctcaaacaattaaaacgcaagctggttttcaacatgttgcgtgcagctgcgaaggctagcccgccgctgccgtcgcgcaccgctgagcgatttcgccgttcggcggccaagcgcgatccgatgcgagacgatctgcagacactgagcggccaaggcttcatgacctatgaggcggtggtgcgaggctgggggaagcagcgtcaggcgctggccggccggctgagcgagcttgtgcggcgcttgcagaacggaccgctgatatctgtagtcgtgcccgtttataatcccgatccggccctgctggtcgaaatgattgagtcggttcgagcgcaaagctatgccaattgggaattgtgtctggctgatgattgctcgaccgatcccgaagtgggccgcgttctgcgcaactacgccgcacaagatccgcgagtgcgcgtggtctttcgtgaagcgaatggtcatatgtcgcaggcgagcaatagcgccatcgagattgcgaggggcgcctacattgcgcttctcgatcatgatgatcttttggacccggatgcgctggtgctggtggtgcaggttatcgatgcgcatcctgatgccaagatcatctacaccgacgaggataagattgttgagggcggtactcgttgcgatgcgcatttcaagcctgattggaaccgcgatttgctttacgggatcaattacatctcgcatctgggggtttttgatgcggcgcttgtgcgcgaggtgggggcgttccgcgagggctttgagggcgcgcaggattacgacatgcttctgcgctgcatcgagcgtgtccaagatcgccagatccatcacattgccaaggtgctatattcgtggcgtgcaactcctggcagcgcggcggcttcgaatagggcgaaaccctacgccaacgaagcgggacgccgcgcgctggaagagcatctggcgcgtaccacgggcaaatcgattccagttgtgctgggcccgattcccttcagctatcgcgcgctttggccgatggaggggacgccgctggtctcgattattattccgacccgcgaccacctaaacgtgctgcgcgcgacggtggagagcattttgggtaggactatgtatggcaatttcgaactgatcgttgtcgacaacggctcggtcgaagcggataccctggagtggttcggtcaaatcgagggcagcgatcggcgtgtgcgcgtgctgcgagacgcccgccccttcaactattccgcgctgaacaatgccgccgttgcgcaaagtcgtggtgagatcgtggcgcttgtgaatgacgatgtcgaggtgatcgcgcccgactggctatccgagatggtggcattggcgcagcgtccgggtgtgggttgcgtgggtgcgaagctgtactatccagatggccgtattcagcacgctggtgtggtgattggtctgggaggtgtggccgggcatggacatttgctctatccgggtgagcacgccggttatttctgtcgacttaaattgcggcagaactacagcgctgtcaccgcggcctgccttgtgatcaagcgcgagattttcgacgcggttggggggctgaacgagtccgagctgaccgtggccttcagcgacattgatttgtgcctgaaggtgcgcgcggcaggttacaacaatgtctggacgccatgggctgaactctatcaccacgagtccgccagcaggggccacgaagacaccccggaaaaacgggcgcgcttccggcgagaggtcgactatatgaaaaggcgatggaaaacgcatgacttcgccgatccggcttacaatccaaacctagcacttgagagaaacgatttcgtattgtcttcacctcgttggtgtatcagcacgaaactgacgtgatggccgaattggctggccccttacaggcgtgtagcgctgccgtggcaactgttggggcatccaggcagctcgcgcatctgaaccagcttcgcttggggtcgcgttcgactatcaccacgccagaggagctcatcgggcacatgggcaagagagtcatgcagtcgcaaagaatgatcctgaactgcgaatccgtgacctaactgagctgggtttgaacgaaagcgcagattccaccgattccgcgttgcgtgcctgcgacgggattgtcgacgcaaccgccgacgcgcactgctttaatttttgcgccgcggtcgcagcctctcatatggggagaagtgtttgtcggcagcttctgctttccctctgcaaggaagcctgacagcaatctctccattgccgccgtcaagtcgtccggcttctcttcgcggagcctttccgcctatgcgacgaaagccgagagcaggctcttcatttcatccggcgcgtttctcgaaccgcctgagcatctccagcccgctttgtgcatggccgagaaaatcggcgtttcgctccgtaatctcggccagcatctcgtttgtgatgcgctcgcttggcgcggcgaattcaccgtcgaccgcagtccacgtaaaggacgcgttcttggctcggggcgacgtctcgtgaaactcgtcctggctctgcccgaacgcctccatggcagcctcccagtcgccacgggctttcgcatctgtttcggcctcggagcccttcagcatatacgcattcgatttgttcttggccgcgtgacccccgaaggctgccagcaccttcttctgttcgagctgatcagcacggcccagtccccttccgggcgtaccggggatcgcttgcattcgccgcattagcgtggcgatcgtttgagcaatctgggttttgcgtcgcggtcgacagatacggccacaggcgcggaatatcggccgccggagggccgggtggatttgccaacgttggcagggggcgatacgcaacgcggcctgggagcgagataatccagtactcgccgaagctcccactgatgagtctgctctggatcgaacgctacgcgctcttggacgaaagccgacggagcggattgatcctcctgcccttcccgaagctcctgtaaccgactgctagcttcgcgcgacggcctgggctgcgcagtggcgccgccgataagcctcggttccatcagtactgcgctttcaggattgatggggaccacagtctcgagctgaggactgagcttagctcgaggacctacgatgggcgcgcccgccgaccgaaaggtccggagatggtctattgccccaaggagtttgccgggattaccctttccgatgaacgcggacacgtcaccgctcaatgacttactgtcgacctgagcaacaaggcttggtttgttttttgcgaagagccaacggctaaagctacgaagaggactcgcatatgtgcaggcggagtctcttgccatcccggccttgatgaaggcctcctcaagccccaagagttcgtgagcatcctcggaataacaggccgctcccacggatccccgcgggccacaatcccagttggttgagccggttgcagcgccgaggcggctggcattgccccaccaccttcacctgaattggcgacctcgctcagctgctgctcaatggcaagggcttgcggattgtttagggtcctcggcctcttcgctgctctcaactcagctgtgtcatgctcatcgttgatgaggatttcctcgcttggcaagaggctgctcgtggcaactgcacccatcggctcgtccggggactgctggctgtcaaacacattcgttgagggactacggtgtggcccctgtcaggcatcgcgttatcggcttggcgcgcctcgtgtaattgctgctcaaagtcctcttgcccggatcggtccggttgatgctcttgcgagacctctatctgcggcccggcagttacattgaacgattcaacattgtgcgggtccacgctagcctcacgccatgaaatcaattgagctggtcctattaggataagctttcgagaagctgacgaggacgtcgctcgtgaagcaaacgcaccccgagaatgccctgcggtcctcgatgggtcgcggggcctttttgcgtttaaggacacgtcgtcgcggctaatacagccttttggcagcgccgggggcgagacgcgttagcgctctgttgcgaagggcacggcataccggcgccgccgatcgtgtcgagcgtgatacttgcactacggacgtcgaggccgtgccctgcaaagggggcgcgcatggcgccagcatatagcacgacacgcgtgaccgaaagatgactgacggctggagatgtggggcaagcgcctgacgcactactcgccatgtcggccctgggtttgcaacaaaggcgtcgtcaagtcggaccccacacagccaagctcggagccgatcgtcggcgatcccgaatttcggcaagattgataaactcctcaagggctgggatcgtctcatccatgcggccactgcttcatcacgccaatattgcgcgagaacggagagcacgtcattgccatgtgcagctaactggctttcgatcaagtaccttcgcttcacttcccgataccgtccgcatggcacttgaatcccccgccatcacgatatgatctgtttgcgggtaaatcgatcaatcgtttgaacgggtctcgggatatttgcgcgcgccgcgaactgcgggtgcgagcgccccgcacggggagagaccgtaagttcgcgcccattcattctaaacccgagtgttttggcgtatccatagtgctgatgagtggcatgcaaacattcaatttttccagcgccaccgatgtctcgtaaaactagagatgtaaatgtgattcagggtgtcacagaagaaattcggacttgaaaaggggaggaaatgttcgctctcaggataatccatatcgccctatcgtcgccacaaggagacttccaagcggagtcctttgcgcgcgcgctcaggtccggtggatactgtgcagaagaagcagtggggcgccatgcgttgtgatgaaagatttgccgcgacttttttcgtctacatatcatccgcgtcgactctacagccggtacaaaaatcgcgccacggccccgttttgtttgagggaatgccggggcccccttgcagtgggcgcgcagcggtcggctgtcgcggagaaatgcacagggcatgctgcaactggagtaaatgtgttgcgcggcgttgtgtaccgatcaggcgagcttaccagtcgtaatatcgcgccggatctgagtctcccccaagtggcggtctgctgcatccgattcggcaacccctttctgcgcggcagggttgggaaaagaagacacgcgcccgctgatttttcctgagccccttttagcttgaagctacttgaagcagttaaccgcacgagagggcctgcacaatcaagagtgaagtagtgacacctggagataaaagatcacaagaactgctgatcgaggcagcatggcatgcatatcttgcaaagaacttgccaaacacagggatgcgcgatgttttcattgcggggtacgtggcttgcaattcaattgcatctcacgaatgtgaatgtaaacccgactatggttcatgttgggccgtatctaagctggttagcaagttccgcatctggcgacgcaacgcaaagtaaacatgcgcgctacgcaatatcaatcgagtaattgatggatacaatggccaattcaatattaggacaggaaatcactttcctcaaacttgatacccgagtgatcaaaaatttcgacaaggttcttacgaataatattgaggttgtggaaacgtctctgtggtctgtagtaagaaagaacgccttaaaaaagggcgcagcaaaggcactgcaagcctgcgcgtcgtcagtgctgcacaaaagatcggactatgaattcttgaccaccggcaatgtgctgcgaaaaaaaattcgcctcccgcgtttgttcggcaataaggtaatttccgcggcttactcgtggataaaacgcgtgcaggcagcgcttttgctcgattatttgaaagaacatttatcccagtatgactgggaccagctgatagttgtcgtgtttaacgggtcgaattatccagaaagcgtgctcgccgaagcatcgaagggatttaagcgcgtttttgttgaggatgggttttttcctgggacgctccaaatcgacccagtaggaataaacgctgcaaactccgtgcctcgctgtagcgctttttataaaagcggcagggatttttcggagggagggttaccaacagctgtgaccaataggtcatcaaaaagaaaatttacccctgtcgatctggccccgggctttgtctttgtaccgtttcaggtcccttccgatatgcaggtaacgcttcattcgccttgggtgaaagacatgtacaatttttacgatatcgttgttaacgcagctgagcaaaatcctgaggagatgtttgtcatcaaggagcatcctagattcaagagatcggtgatcggcagtcgtccgccacacccgcgcgtgaaatttgcaaacggaaatatcacctccgaacttatctccaatgcgaggactgttgtcacgataaattcgacggtaggcattgaggctctgcttttggggaagcaggttattacgcttggcgactcctgctacaacattcaggatcttgtgttgagaggaaatgatatgggccggctcaacgccgcacttgcgcttcggggatggcttcccgacgatgaattgcggaggcagtttctcggcttcctgtggaattactacttagttaagggtagctttacagaaccaccaaccgccctggcctctcggattctcgattgtttcgaactggactcagaagtgagaggtgccatcgcaaatttgaacaattgaatccatctctgcagagttctctgcgcctcttcaggttgtgagtgttttaccttatggtggtgggcggcctcggctcccgaggcctcctccaccatcagaccacgtcgtccattttttattgcacgcatttcgggcttgcttgaggattgaggcagttccagcgttctgttgatgggattgcaaacgttgccgatggtcttcgagagtgcgtcgaaggtcgttttgaagttggcgagagctacaccttcacgtattgaaacgagaccggaagttcgcagagtgatggctgactggagtccttttccgacagaacgtacgtggtcatctttggccaattgattccgatggcgggatcgtcccatttcagtccgcgatcatgttcagcgctatagggcgctgtcaccttgtagctgattaccgtgtccgccttaagcgtcatgaaaccatgcgcgaagcccgcaggaacccaaagctgcgcgccattttcctgagatagctcggcggaaacccatttcccgtatgttggtgacccgaccctgacgtccaccgcgacgtcgaacagcgcgccgcgtgtacagcggacaagctttccttgcgcgaaaggctcgagctgaaagtgaaggccccttaccgtcccgatctgagcggagagtgattcattatcctgaacaagtccgacatcggcaacatttttgcggaaccatttttccctgaatacttcgctgaaatagccgcggcaatcgccaaacttcctaggcctaattaacttgacttcggctatcgacaggctttgaaaatacatttcgtccaactcagttccgcccactaattctcgtgctctggcaaggagttgaggataaaaaccgaacctcaactcatagcgcgattgtgggctccgatccagagactcacttaggcgctcggcaacagctgcaactcataaaggcggcggtatacgccatcttgtgaaagcaatcttccctgcggtccttgttcggcgacctgaccgccttccatgaccacgatgttgtcagcagctgtgaccgtcgagaggcgatgggcgatcatgatagtggtccgcttccttgtcagccgggccagagcttggcgaatctggatttcggattccgaatcgagtgcgcttgtcgcttcatcaaaaatcaggatttctgcgttccgcagcatcgcgcgggcgatggtgatgcgctgtttctggccacctgaaagttttatgccgttttcgccgacctcggtgtcgtagccatgaggcattttcataatgaaatcgtgagcgttggccgtcttggccgcctcaatgatctcctcgtcggacgcaccctcgcggcccaaagagatgttgtattttatcgtgccactaaacagaaatgtgtcctggccaacaaatcctatccgatcgcgcaaggaacggaacgtgacatccttcaggtcgtgcccgtcaacagttaccgagcctacgtcggggtcataaaggcgcataatcaagttgataatcgacgactttcctgcgccggaaggccccaccaaggctgttgtctttccggctggaaatgtgacgttcaaattctggaaaagtcgttctccgttcttgtaggagaagttgacatccttgaagcggatttcaccagggccctcaggcaatggtattgcactattcttctcggtcagttcaatgggatgatctgccagttggtacatcatgcgaacgcctacgagtgccgattcaagactgatgcgcattcgcgcaaggcgctttgcgggctcataggccagtagcaatgcagtgatgaaggacatcagttcgccgggcgtgttgccctgctgcagcaccaacactccgcttagtgcgatcacaccggcaatggcgaaacctgagagggtctccatgatggggctggatgcagcttccagccttgcgattgagttagcccgccgttcgacatctccaatgtacttgtccatccgccttctcatgaaatcctcaagcgcgaaggcctttacaatccgaattcccgtcgaggtctcctgcacgctctggattatctgtccgattgaagcaatctccaattccatgatcttccgcacttttctcgttagcacacgaaccccgaggatagcaccaggtccaacagcggcggaaacaagtgaaagtaacggttgttggatcaccatgaccgcgagcagccccattaacgaaaacagatcccgtatgaaggaggttacgacgagctcaatgaccgaacgtaccgcctgcgcattgttggtgaggcgaaccaacagttctgaagatggataaatcgaatagaaagacagaccctgcctaagtacgtgctcaaaaagcctgcgctgcgtatgtgcgattatattgttgccagccttgctgaggaatattgactgcacgtatgtcgcaagtcccttgactgcgaaaataatcgcgactgtcaccgcgacgccgaaaaccttttcaatgtcttttgagacgactgtgctattgacaacatcacgcattatccaggcgcttgcggaggtcatcaccgctactacgaccatcgagccgattgcaattccgtaccaaggtgcctggtgtttgaaattttcagctaaaagccgcatgagaaggctttggtttgacttggaaatgaatttctggagcattcaattatcacctttccagtccggtcttggagaggagcggacagtcattttgttaagcagcataggccttcggtggcagcctaaatgacccgtgtggcgttcaaattgcaagacacatgaacctgcttgtggacacaatcatttactaaggacaattccacagtgctatggatcaaacccttagtcgccgcttgtttctatggcacaacccgcagactgataaccagtgtagaaatgaaagacacatgattcatacgtcaaaaatttaccgtgaaatcaaccgtatcggcgtgcaaatcaaggggctccccgactattggatgggccaggctagaaggatcagttatgatcgggttgggtcggcaggaaacacgataacggaaggtagaaaaccagtctcggcggacatggctattttgctcatttaccaaccacgtgggcttctagagtcgctttttttacaattagagcacctgctctcgaaaggactgggcgtcgttatcgtcagcaaccgcaaggttttggagcacgatcgcaatcggttgagtgaatattgccatctgatcattgaacgtaagaatattggctatgattttggcggctatcgagatggaattctcgcgcttcataagcgttcaattcatcctaagagcctctttgtgatgaatgatagtgtatggtttcccatacggaaagactgtgatcttattgataggtgtcgcgaatctaggtcagatatagtaggcgttttttataacaataaaagcaagttccccaagaaccatcatctacaatcatatttttatcgtttcggtgaaaaggttgtctctgatagtcgctttctagcgtattggcgtaaaataccaatgtacaatgacaaacgcaatgtcattaggaatcttgaaataaaattaaccaaaaattttcagttgatgggcttcggcatcagctctctttacgcgcctgaggatatattaaaggcgtttaaaaatatcgaagttcgaaatatccgtcccgtcctggattactatatctccgcgttgggatatgaccagaatacgttctggagcgcgtataaaaatgagtcaccaaaaggaggtgacacccatgcattaccgatagacgttcctaatagccgagttttcttccattttcttgacgctcacccagagattctcattcgcaagttaaactctccaatcattaaaaagaatcgcgataaacgctttgtcgcacaacgaaaagcgataattgagggagggtttcttaaagagattgacgccgtcattcaaaaagaattgatcaattgggataggtagttgatattgtatccaggtcgtcggaagcgtgaataatcacactatcaaatcagccacgtagattaaggcgctggttatgccccttagagcagctggaacgggctcttgatgccttacgtccgcattaatgggagtcacgcagcagcgaagtgatgtgcacattcctgaggtcgaccattttaggagacggcgcgtgctgaaatgcggcagaccactgctattgaattttcatggaatggccgaaagcaagagaaataccgtgaatatcgccagatgaacggcgccctgtagtacggtcgttctgcccgttcccagtgtgatcgtaccgacgaacagcgtcaggatcagcataatgaggttctgtggcgcgagacccaaagcaagatctcgtccaagagcgaccgatatggcagctactactggaattgtcaccccaatgctcgcaagcgcagatccgagtacgaggtttatgctattttgaagacgattcattaaagccgctttgacagaggttatcccttctggcagcagaacgactcccgcgatagttacgcccacgacggcttgtggcagtcccagcgcctcgacggcgctgtcgagcggataagaaagtagcattgccaataggatgactgcaatgagggccagcacaagcaaggctccggccgctagcggattacgcggggtctcatgggtagccggaggcgaagcggcgtcttcatcatcgatgaaatagtcgcgatggcgaacagtctgcacaaacagaaacacaccatagaggaccacagacacaagtcctatgacgacaagctgtattgcagcaaactgctgtggttttcccgcggtgacgaaattgggcagcacgagagacagtgtcgcgagtgtgcctagtaccgccagtgccgccgacgcggcattcaactggaacgactgctcgcgatggcgtcggccgccaagcacgagacagaggccgatgacgccattgagcacgatcatcacggcggcaaagaccgtatctctcgcgacttcttcgtttccctccgcgccggaaagcatcaaagaacctatgatcgccacttcgatgattgtcacgcagacggcgaggaggatcgctccagaaggttggcccacccgagcggcaagaatttcggcgtgatgtacggaagcaaagaccgcacctgttagcaagccggccgacatcaacagaagtacgacggatcgttccggcagcacgtgcgccaatgtcatagccgcgatcacacaaccgaagagcggaatgatccaagaccacagcgggacgtgtgcggacctgacctgcaatcttgatttcattttccatcccctggtgatgagtatgcgtggttccttgcgcggtaatcggcgtaacaaaactaaggcttcggaaagtcgggcgagattcgccaagtctagtcagactctagacgagccgtcgagtttggcgtcaaccgcccctcattgcagatgcaagaagtatgctctgcctgccgtgcctttcatgtgattaggtgcgtcaaggctgtcatgtacttgaaggtgcacggagctaggctccacagtccaatccaggtctcctattttgtgaggctctgctcgaggcgcacgacctcgcgtcgcaacgcttcgatcgctgcatcgcgattgcgaagcgcttctagctgtgtggctcggtcatcctcggaagccatgagcgcccgtttcagctgagccaccattgatgcgcccagctgcaggttttcacctaatttgaactcgggcagccgttgcgcttctccaagtgtggaggagctggagctaatggtgttgtcctcttcagcttgctgaaagatgctgttgtactcacacgcaccggcgggaatgccttctccctcgccacgacgtaagtcccaccaggtttgaaatacccgacggtatcgttccgttaccgctttgcccctgtccacgatcccagcgtctcttgcgtgctgaagtgactgctcgtaaccgagttccaccaataggtcagcgccgactagatcggttactgtttgcatctcttcgatggtcagttcggttcgccaagtttcgactgagcggttgtcgactgcctttttcttcaggagccgtcgatccccaaagctacttagccggagatattccgtttgctcaactcctgcaaatacaatgccggctggatcgtagccgagcccagcgatcacgcgctggatttcctcgtctgggcgctcaaccaagcgttcatagcgtacgacttgcgtgtgccggcgcccgcgttgcatcgcaagcgcgggtaggcctagcacgagatcggcgagagccagtgcgacagcagcagtaggcgtgccggttacgagctcggcgagacaggatacactggtcggcgggcacctttctgaaacgaacggaacgccccacgtcgatttcagtgatgccgcaatcgcatatggattacgcaacaaaaggatgtgtggtgcttctggatacagggaatgcaaatagtcgagcaccatccagtaccgcggagtcttgtcgatcaacgtgcgcttgcccgctgctgctaagtattgagagtaagcggcatcggcaaaaactcggctgacgctaatgcgatctatccgccccaagaattcgcacgccgcaacctggatcagtgatgcccctgctgggtgacggtggtccactctaccaaatgcctcgagtgccaacatcagccagggctcaggcggggctgtgatgtccgggtgctgctggagcaaatgcgccaacagcgtggtccccgagcgggggatgccgaggagaaaacagatcagagggagagggctgacatcgcggctcatgagttccgattccttatgcatgcttgtgagaacacatacccgccgcgcgtgagtttctgatcgagccactgggcgtgcgccaccggttggttacagtggtgtacaccggagaattcttcctcagaaccacggcacagaccgatagccatcctgatgcgccggacttcttctaaccttcgtctgctatgcgcggttctcgcaagcccggtcaaatcgtttctgccaatgcaacacatccatgctttggatgatggcgcgaagcacgaaaacgcgtgcgaagttcgacatctgggatggtgcagactgcattctgccccaacgaggaaaccaatgtgctgacatcgggaacgcattcgagcataggttttttggcccacagtggaatgtttacgaaacgcactcgtcaaccccatcaaaatgatggcctcagccctcatgtccgtcgcaaatctccattccgccgcgaacggcgcatggcgcgcgagatgatggacgaaggagggttcatcgaaattcttgtcgataagatttcgagatgacgatggggcacgccgtctttaaggcccctttttgcaccgcgcttcatacccgtcgagcggcgagacgaggtcaatctcactgccagtagtgccgctggcctttcccttggggccgatgccaggcagtgatcattaacgaccggtttttgggtggagcggctgacaaagcagcatggattttccgtcacccgcagaaccacacgtgatgaatattaagggcgagttgggtcgcgcttctagctcgcccagcggtgaggacggatgtggcatcatgaatatctcccgcttcttcttccccatcccgcttccacgacacccccaagcaactgaagtagcatttctccgggcagtcgttcccaagcagcaagggcggcaaatgtgatgcgcaccagtgggacagcccgcaacatggaagagaacaagccgactggtgctaaagcttcgtgtttctgagcaaaacgtcaccctccactccgcgtggaaactgagccaccaattcgaacgaaggcagtaggtcaagaattgcgcgcaggggcagttgaccttcatacagctcctggtcactatattcagtgtagatgaagcgcgtcttggttagagtctctttgccgccagcgatgacgtcggactcggccccctgcacatccatccagatcaggtcgatactctccaagccagcctcactgcaccaatcgtccagtctccgagtctcaactgagatgggtccgtcaaaccggacccactgatattcggaaaggtgattcttgggctggcgtattgagcctgacagatcccattcctttgcgtctccatctccattactggggtggaaatcgattctgccgtttcgatcactgatcgcgacttcaaatagcctcatcctgtccaaaggccccatgttttccctacagcgagcagcggctcgggggtctggctcaaagcagaaaagctgggccttcggacgaagctggagaaagcgtcgcgcatcgcttccatcattgcaaccgatgtccagaatcacggggtcaggcttttcaaggagcgaaacgatctgtcgatggaccttcaaggaagacgttggctttcttatgccctccgcaaattcgcgaaggcgttgctgaagagagattagcaggccttctttaagataccgtcctacttccatgaaattacacctcaatattgattgcagttgcgggtgctgaccgctggtgaggcattgagtgctcgtgccgcgcttcggtgaatcctcaagggtatgctgtcaaatgccgcgccatcactcatgagcgtctcggccccaccagcatgggtgaaggagagggacggaactaccgcgattgtcataggcgggcaccgctttacagattgattggacttgatagtggttccgctgcagagtcggcgcgcattggatgcagtcgcacgctacgctgctcccaaagcccacgcagttcatttaggagcgcttcacgctggttctgattgggcgcgatgaggtccaagatatcgccgagcggagcttctccatcaatccgcattagcagttcgaacaactcggatgaaatccgcacggcttctcggctggagggacccgtgcggatctcgcataccgtctcttggcgatctaacgccgtaaatgcacgcacttgatggaggcttgaataaggcggcaacgaaagcgcaagtctactccaatcctccggtgacgcagtccgcttcttgatgagatatgacccaaccacgagtccatccaagtcggtggtcaaaaatgtggtcaccgcatccgcaaccgaatccactatcggctcaacattattgttgaaggacgtgttgagcagaatcgggacacctgttcgtttcctgaaggcgttgatgacctcccaatacgcttgattgatgttgcgcgatactgtttgcaagcgcgccgtaccatcgacatgcgtgacggcaccgagcagattgcgcttcgattcgcgcacaggcactacgaaattcataaagggaaattcctgcctgctatctggcaattcaaagaactcgttggcgtcctcctccaacacggatggcgcaaaggggcgatagccttcgcgcttcttgacaatcgcgttgatccgatccttgtttgtggctggcctagggtcggcaagaatgctacggttgccaagcgcacgcggtccgaattccgatcgtccctgcacccagccgatcacggcgccatcggcgatccactcggctgctctgctggccacatcatcgcagcgttcgatttcaatgtggccgccccatgctattaattcctgctccacggcgcggtcgctcccgagatcaggaccccaatagacctcctgcaaacgctcccgaggtgcggactgccctagttcattagacatcatcaatgcagcgcctaatgcgcagccagcgtcgtgtgccgcgggttgcacgaagatgtcttggaagattcccgagcgcaacagcttgccgttcaatgtgcagttgtgagctactcctccggccaagctcaagcgctttatgccggtgatctcgctgtgatgccgtagaacgtgaaacacaatccgttcgagtgcttcttgcaacgaagcacttaaatctttatgctgctgagtgaacggcattccttttcggcgtacctcaatgctgcgaagcagcgtgggaccaatccggtccagatagatccggtagccaccgttgtctaatagctcgtagaactgttcgaagaggtcgcgatggggagcggggtcgccgtacggtgcaagccccatgaccttgtattcatcaaacatgccgtaaccgagatattttatggtctcaaggtacaaaagccctaaagaatcgctctccggaaatgtcgcaagcggtttgacttccgtgccggatcctaccgccaaaagacccgaggcgaagtctccaccgccatcaattgtcaagatgagactttgttcgaaaccagacatagaaaacgcgctccaggcgtgcgacaggtgatggcttacgaatgagattcgcgacggatcgacctcagtaccaaattcctgcgcgagcaacccacgcaacaacagcttggcatccaacggtattgacatgtgcgactgagaaacgagcaggcgctcgagcatagcattgcaaaacgcctcggttgcataatacgcgatgcagtcgatgtcgctgagttgaaccccggcgtattcaaggcagtattgaatcgaccggcgcggcagcttgttggaatgtttgattctgttaagtcgctcctcttcgacagcagctatcacttggccgtctcggacgagaaccgctgcaccgtcgtgcataaatgtattcggcagatcgagcgagttttcgtgaatcttgcttagaccgccactaagtcctagacacagcatgttgtctccaatctctcgtcacttgtaacaggtaggccatgtgctccgactgaatttagtcgtttgctaagctcaagcagtgctctttctgccgtaggtcaggacagcaaacgccgctgaagcagtcccacagataagaagaatggcatcactgcaaatatgcaaagcgcgctgatatgcagagcgacgcctccgcctgggcgatctagcatcgctggacgaatgagctcgattgaatgtgccagcggcagcagatgcgatagcttctgaaaaatgtcgggcagttggctgactgggaagaccgctcctgacaaaaacagcatgggtgtgaggaagagcgtctggtaaaatatgaaataatcgtaaccgggcgcaagcgctgtgacgatcatcgccaggcttgcaaaggcgaaccccgtgagtgcgatcactggcaaggcaaagagaacggatggccacgatgcaaagcccattgtggctgcaacgagcatcattgctgtcccggccaataacgccttgctggctgcccacgccagttcaccgaggacgatgtccccgagcgtgagttgggtgcacagggctgattcccaagttcgttttgcctgcatgcgagcgaaggtcgcgtgaatagtctcgaacgtcgcggagatcattgcgcttgttgcaaccatgccagccgccaagaacgcgacatatggaatgccgtcgacgcgacccaccattgcacccaggccgaagccgagaccgaacagcgaagtcacgggctcggcgaggttaccaagaattgaagcgatcgcggctttcttccatgccatgtaattacggcgccacaccgcaatccaattccaaggattggcgggtaggaccgccgcgtaacgtttccacatcgctcagtccttcatttcgcgcccggtcaaccgcaagaacacatcttcgagattcggtggacgctgcaataggcgtagaccggttcgcccgcgcaattgcaagcgcacctgttctggatcggaagaatagcaaaacagcgtctcaccgctcacttcgacacgctgagcatatggtccgacaactgaagtcagctcccgcggattgccgccgtagatctcaatcacgtcgcacccgatctgctcgtcgattagcgcgtgagggcggccttccacgatcttccgtccgtgctcgataacacacaagcggtcacataatcggtccgcctcttccatgaagtgggtagtcagtagaatcgtcttgccaagcgccaacaaggaccgcagccgttcccatattaggtggcgagcatgcggatcgaggccggtagtcggctcatccagtatcaggagctgcgggtcgttgatcagcgcacaagccagcgtcagccgcctctgcataccgccggataattgcgccacgggtacatccgccttgctctcgagccgagcgaaatcgagcagtggtggaatggcttcctcgagctcgcgagtatgcaagccgaagtaacgtccgaacaccagtaggttctcgcgcgccgtgaactcgcgatcaagtgtgtcgaattgcggaaccacccctatgcggctgcgcgccaaacgcgcgcgggctggcaccggctctccgagcactgtgatcgtgccttcatcaggcggtgccaggccgagaaccagacgcgataccgtgcttttgcccgcaccgttcggtcccagcaagccgaaacattctcctgaggtgatggtgaatgacagttggtcgacaacgactttgtcgccataagacttactgacgttggtaagctcgattgccacatctgatttggagcgagatagcgaattatccgcattgctatgcccgtggcacttctgcttgagtgcattgctctcaggccgccgcgacggtgagcttgagacatttgctcgagtcaatagctgcaatttctcgtcctatcttaaattcgcttgcctgtttggcatagccggctaccgtcaccgcagtgactgactgatgtcagcagcctcgcaagctgcgcaagactgagccagcgacgcgggtgccgcagtttcagacggctccgcagcgcttgttttagcaatggggttcaggagaatcctttacgccgttgggtgcggcagccggggaaccacgcgacagccagtcgctgttgctcaacgtgcacaacgcatatgctttgagggggagcaggagagcgacgttgaggagggtgtgcagcgaaaacccaaggaatcgcagctctcgcgctcgaaacgccgccacgccgcagcggaccattgtcatagatgcaatcatcaggatcgtcgaccaaggcactgtggccgtcagagcgagctgtgctagccccgtcaggaccgagagggctaggagcagcggaccaagattctgtccgatcacgtccagcgtaagatagcgatcaaggcccggcagtaggcggagcgcgagcaatgtgtcgcgaaacgtgctgcgtgcccagcgcagttgttggcgcagataggcgcccatcgagtttggaacgaccgtcgccgcgatggcttccggaacgtactcggttcgaaagcctgcattcagcatgaggattgtgaggtggcggtcttccccgaagtcgcttggcctgcctcgaaacagttgcgtctcgtatttatcgagcagcaataggagtgcggaccgccggtacatggcacacgggccgcagcaacacataacggctccaaagcgagcctgtgctgcgcgttcctcgttgcaggcgagccagtactccatgtcgatcaaccgcgtcagccatgtgtcgctgcggttgctggccgtcaactgacccatcgccgcgccgaccgcgggactgtacatcttcagggcaagtttcgtgactacgtccggcgcaatggtcgtgtccgagtcaacgttgagcaccaaatctcccgatgattcccgtatcgcgacaatctgcgccttgcgctttccgacgttctttggcatcaggataaagcggaacctcgggtcgcacgcataatgatcgtgtacaggtatgatggcgttgcgattgccagaaccgtcgtcaaccacgtagacccgcaactctccagcgtagtcctgctttgcaatggaagctaggcacgccgagagcgcgcgcggatcctcattgtagcagggtacgataacatccacgctcggcggtgcaccggagccggtcacgggcgttgacgcagctgtggtgtttgttggcaaagcgtatatagcttgcatgcctttgtaagccgtcgagagtgctgcatacaaggagatggctacggcgccggtcgtgccaagcagatccatgaaaaaccgtccgtttaatgattctgaggaagcgagcggattataaatccgcggtcgtgcaaggcagggatgagacgagacaacgccgccaccgtctggtcgcgaaaactggcgtcagtgttcgccaactcgtcgggagggcacccatcgtgcaggagaatgattgaaccgggccggaccgaggcgagtaccgcatcgacgattgcgtcgataccggggcgggaccagtcccgcgggtccacagaccagtgcacagccgccagtccagcgtttgccgatgttgtcagcacgtcatcgctccaaattccgtaaggcgcacgtatgtgccgcaccgaagcctcggggcaggccatcctgatggccctgttcgcctcgagtacttggcgttccacgtcccgacgtccgcaggcagacaggtccggatgggtcattgtatggttggcgacctcgtgcccttgcgcaaccatgcgtcggatgagttgcggccggtccttagcataagccccgatgacgaagaaagtcgccgggacacggtgttcggccagcacatcgaggacctcaggggtaaaaaccgggttaggaccgtcgtcaaaggtcaggtagacgctcggggccccagtgccgcttctgggcactgtccggagatagtcaagctgtttcatagttccggaccgtttcgttcgatcagtgtgccggatggccattcgctcattggacgtccaatcggaaagaccacaacgagtacgtcttcagtgcgcgttggcggcaggttgagatagacatctgaaagggtggaccgcacgcgaacgccagccacaattgtcccgagaccgtttcggcagagtctgcccacaagcttgtacagcgcgtggcgaacggcgccaaatgcgaacggaacgccaagctgctgcagcaccggatacatgacgcggatggagtggttgagcccgagtccttcgaggtccgggcgaaccccccacaaacccagttccgccaccaacagatcggcatcgcccaccctgataaagcggcgcaacagccccatgtgagcagccactccgtgagcgtcgtagccgattacacggagctccggccttgctccggcccaactgtgcccaccttcaaatggtcttgcgttgaacgtcccggtcggtccataggtcttccggaagaactcagcgagttcagtgtggtcggagagctccagctcattttcccagcacagtttccaccgcatctgaggacgcatatccaaagaactccacatcttgctgcttcttgaaacgtacatcaaacgtccgaaatggccggggtcgatggacgcccgacactgtcgtcgaacccgcattgcggaccaagttggttgttattacctgcacagtgagtgggggacatttcccgaccttcccgtatcactcgcaaatctctaccagcgacacacttgatttcttcaaacgtgagcatcttctaatagtgattggatggatccgtaaaattgattgtttggattatagccattcatcctgtggatacacccggcccaagtctccctgctagcaacggttgatgaacgaacccgacaccgcggcgggagcatcagcttcggcccgccaatcatgggcgtgcggccacgctctcgaaaacaaggaagttggatcaaagaacaggctgagacttggccgccaacggcaatgaagctaataccgctactgctcccgcgccgttcggcagatacgtttcggccacagccacggcttgttcggctcgggcagctatatcaggcagtgccgtctcgtcgatcaggcgctgatttttcctgtaggatggaacgtgggcgtaaccaaataccgcaagccggtcggggcgcattgcgaccgctgccgtcgcgctctgaacgcaggactgcacggtctggtgcgggaggccgtacatgaggtcgaagttgatgcgacttatcccaatccggcgcaggttttcaatagccgcggtcgtctgcgcctttctctggacccggttggttgctttttgaacaatgggatcaaagctttgcacgccgaggctcacgtggcttacctcggccgctcctaaggcttcggccatctcggccgtgaaggtgcgcggctcgatctcgacagcgatggtagccgttttcctgaaggcgaaactgcgacgcagaagatccatcagagccagaaaatcttctggcttgatgatggttggtgttccaccgccgaagtgcacgtcgctcacgggcagcgcctgcggcgcttgggctgctaccaaacttatctcctcactagcgccgtcagatagtcgaggatcgatgcgtctcgacgagttatgctgttgggaaatccgcaataccagcacatcgaccgacagatcggaatgtggagatacaacgacaccggatctgacgccggcaagttcctcagccaccccttactagcttcagcgccgacggctgcggagaaatccggtatagtcgatcgtgtaccatggtaggtgcgcctcgcagtacttttgcaagagtggaggtcagcggcgcgacacttttgatcaaacgcgttgccgcgcctgtcttttcgccgtcagccattatggcctcccgctcaagccactcagcaggccccgctgccgttcgacgaggatctcaaaatccaaccagttgcgtcgagaacattgccggtcagattagccggtacttttcaattccttagtcgagaccgaaacaacaagggacataaaaaatgatctctgtcgcggattcgacaaacgggacagagttgtacgcaatcgatttacattttgcttgccaaaggccgacggcaaattcctgcagaggttgagctacctgcgtgagcttgctgccggggacacgccttggcgaaggtggagaatggtgctgttcagaagtagctcagttgaatatccaacaaacgccagtagccttgctgtttcgcggaggaggaggctaggcggagccgttatcccggcgcccgccgggttgcaccccgccgttgcatttctgccactgaggagcagacagtcgggttgaggtccttccgtggtcaagttgtggaccagacagcagaacgctgagacggtgagcagatgaatgcggcgtcggcagcccacaagaggagacgcatccgagcgttgagaggggatggatggttgccggccaagcggtaacacgaaatagcaagcgacggtggggaagaattccgacatggtccatttattgcaattgatagcattgtgaaagcagccttggccattctgcaacttgaactaatcgtcggatccccgctttccgcgactacaaaattgccgcaccttcacgcgctggcatgctcggattctcatagaggctaaaacagcaatggacacggaagcaatcgggctcgcaatagcttttttcgtcattgcactggcgtatgcagcagtcggacaagctggcgcatcaggctacattgccgccatggcgctttctggcttttcgccgttggccattaagccgacagctcttgctttgaacctgatggtctcagcgatcggcacggcccaattcctgaaggtggggcaggtgtcctggcgtaacgtgtatcctttcgcaattctgggctttccggcttcggctctcggtggctcagtgcaccttcccgagagagtctatcacccggttctcgggctgatcctggtagtttccgccattcaaatggcgcgatccgcgcttcgcaagagcgccttggtcataaccattccgaaaacgccgccactacacgctgcattgatcacgggagctgttatcggtttcgtctcgggcacgaccgggagcggaggcggcgtattcctcgcaccagtgatccttttcaagaattggggaacagcacatcagactgctgcaaccacggccgtttataatttaatgaactcaaccgctgccttgattggagcgtgcgcttcctggaatgcacttccaaactttctcccgtggtggttgattgcggtagcggcaggtggatcgataggcgctttaatcggaagccgatatctttccgcttcctggcttcgcgtcattctttccgtgcttctgatggtatcaggcctcaagctgctttggtgatggagtgcccatttgcttgcacggaaaacctttgcccagcatcacgcaggagcacgcgcgaaggcgcaccattctcatccgcggctaagaccgagagggccaattgtcgctgaatgtaatctccgatgaccgaactcctcaccagcacggtacctggaacgtggctggcgcgcttgcgccgaaggtcgagacgtccaattcagcacatcatgacgccgacagccactctgtcgtgtacgatgcccgatatgccaagcgtcccgaaaaccaccttgccgccatcgtcaacctcgtcgccacgaatctgaatggcgcgatctctaaagaacatcgcaaattcgagagcggtcgccgctcataagataaggctcggcgtcacgggtcatcggacagctctctgccaatacggcaggctgtcggcgccatatccaaagtgcggataatcgtgatgcaaaatatttattttactggccttagcaatgctgcaaaaacgaccacgcttgatttgcatcgatattagaacagttccagagtgctggcgttgaaaccgttttgcggctcaaagaaaggattacccgtggaaagcatcatcggttcggcatgtacaagaatccggttgtccataagggtggacaggtttgggcagatgtagccgtcctgtacgttacacttgacctaatcattgcgtgaatgagttttgccggcagttggggcaaccatggccccgtttacgcggcgcccatctagaaggctgcggggagcagtcgctctttctgcccggcagggctcggcatgtgactatttcggagtttctacattgccttcaaatatgagcttaacggcggatctcattgcagatttgctcagcgcggcaaacgaggtcgacaaactcaacccctatgaaataagcggcctcctagaccgctcgattgacaccatccgcgatgtgcgcgaacagactggtgtcgcaagttcatatatgcagggcgttgtggtttgtcttcgaatatcgtcagagcgcgttggccacctctctgaggaggatgtcaggcggtccctcgtcactgccgcggaagtcctgagtgcattggtgtcaaaccgtgtcgattgagctgttcgcgccgccggagtccggaccactccagctatcttcgatcccgcaaaccgatgcggcgaattcggctgcaatctcgacaggtattgccgaagattgcttcagtcgacgctgcttattggaaccggcgtatccgattcgcgacgatgtcgaatacacgacataggcgtgtcgagaggcagcttcttgtttggaaacgatttctcgttggcatgatacatgcaggctaacccgcaaatgcccgagttgaggacttgtgaggaggatgcaggactaacccgcaagagtgcagttcggggtgcgtcagccttccccgggcaacgaggatccgaacagcaagggggcggcaaataggaaagcaacggccgcgagggcgtttaacagtgggtgctgtgcgaggatcagtcccttgcaatggcttgccgccgataacgttgtagaaaaatagacaaggagtgctcaatggtcttcactggaaaatgtgatctgcggagtccgctgctcggacgacgcctgcgcttaggattcatcggcggcggaaagggggggcttgttggacgatggcatttcgctggggcccggctgtcgaaccactgggaaattgttgcgggagctctttcttcggacccggaaaacgcgcacgcttcggctgcagagtggatgatagcgccggaccggtcgtacagcgactggaacgctatggcaacagcagaagccgcaagggacgatggtatagaggcagtctcgatcgtgacgccaaactggacacaccatcggatcgcgacggcatttctgaaggccggcattgatgtaatactagacaagcctatgaccacaacagtttccgacgcccgagaactcgtggagttacaaagagcgacggatcgcctggtcatcatgacttacccgtatgcacatcacgcgatggttcgccaagctaagcacatgatccgaaatggggccgtcggcacggtccggcaggcccatgtggagtatgttcaggagtgggcgacagcgcccttctcgtccgacgcgaagggggcaatgtggcggcaagatcccgagaaggtgggccgcgcgtcggccaccggagatatcggcacgcacgcttatcatctccttcacacactgaccggacaggacattgccaggctcagggctgagtttcacacctgtggcgctgtgaaggcgatggaagacaccgcctacgtcactttccgtctcgagaatggtgcacctgggatcctttgggtaacgcaagctgctcctggccaatattgcggtcttcgaattcgcgtgtggggcgacagaggcgggcttgagtgggatcaggaaaaacctgaagcgctgcgctatgttcctttaggggagcaggagcagatttttgtgcgaggccacggtagtggaatagtacccgaagcagaacgcctgatacatctaccgcggggacatggcgaagctttagtggatgcatgggcaaatctctatgccgaggctggcgtggcggtagccgcacgccgcgcagggtatgctctcccgaaagatagcgtcgagctttccggggttgaggacgggctcaaaggtatgttgttcatcgatgcttgtgccgacagccacgaatctggcggatcttgggtttcgataaacggtgaatccattcccaacttttgctgagctgtggagtgcggcccttggggtggacagaccggatgacgaattgaccggcctaccgggttttcggaaagaaggcccatggcaaaacaccgaagtcacagcgtcgagttcaaacgtcaggtcgcgcaggaattcctggctgagcggccaaagttcgggcgcccgatgtttggctgaagcgtctttgagcactgctagtctttcgcccgatcacgatgctttcggctccgattgtccggaaggcgcgccagataaggggtatccgtccgagcgcgaccgcctttgcatattgagtaaaactgttcagaccctgtccttattcccatgcataaggacagttgccaacatggagatttttgaaggagacagcgggtctcgggtgagccgtcttgaggtgatcaacaccggacggcggcgtcgatttacggaagatgagaagctgcggattgtcgcagaaagctttgccgggagaggccgtgcgtcggccacggcccgtcagtacggcatcagtcgctccctgttgaaccgttggcgcaaatcggttcgccagggtttgcacggccagaaacaaaccgatggttttgtgccggcgttcgtcatgccggaaacttttgtgccggtgaagcaggtcactccacctgctgcgatggagcagccggtggcgtctccttccggccgcatggagattgttgcggcgaacggccgtcgtgtggtcgtggacggcagcgtcgacgttgaggcgctgctgcggatcatgcgggggctggagacgttgcggtgatcatgcttccttccggtcaaaatgtgcgggtgtggattgcaacgggccatacggacatgcggtgtgggtttccatcgcttgcgttgcgggtgcaggaggtgctgaaactgaaccctttggacggcaatctttttgtgtttcgcggtcgcagcggatcgctgctaaaagtgatctggagtgacggccaggggagctgcctttttacaaaaagattggaccgtggccggttcgtctggccttctgccgaaggcggagcgatagcgatatcacccgcgcagctcagttatcttctgtccggaatcgactggaggcatcctcaggaaacctggcggccgacgaaggtcggctagcattattctattgaaaatacaggggaaatctgatcgaatggcttcatgatctcaaagcctgtcgatcttcctgtggatgttgttggcgcttacctggcgctgcgtggcgagcatgaagccttgcaggctaaacacgctatcgcagtagcggaagccgccaatgcgcaggcgatgctctctgacaacgaggcgctgatcgttgctctggaattgaagatcgagaagctcaggcgcgagttgcggggccagcgctctgagcgcacggcgcgcctgctcgaccagttggaactgcagctcgaggaactcgtggcggcggcgacggaggatgaggtcgcggcacaagcagcaagcgccagaacctcgagcgtacgttcgttcacgcgcaaacggccggtgcgcaaaccatggccggacgatatcgagcgcgaacgtgttgtcatcgagccgccgacgacttgcacctgctgtggtggttcgcgcctgtcgaagctgggcgaggacgtcaccgagacgctggaagagatcccacgccggttcaaagtgatcgagacggtgcgggaaaagttcacctgccgcgactgtgaggcgatcagtcagacgcccgcacccttccatgccacgccgcgcggctttatcgggccgaacctgctggcgacgatcctgttcgacaagttcggcatgcacagcccgctcaaccggcagagtgcccggttcaaatgcgaggggatcgatctttcgacctcgacgctggccgaccaggtcgggtacgcaacagccgctctcatgcctgtcttcgatctgatcgaggcgcatgtcttcgcggccgagcgtcttcacggtgatgacaccaccattcccattcaggccagggacaaatgcacgaccggacgcatatggacttacgtatgcgatgaccggccattcgggggaacggcgccgccagccgcaatctattatgcgtcgagtgaccggcgcggcgaacatccgcagaaacacctggccggatacggcggcattctgcagagcgattgctacaatggcttcgagccgatcgctgttgccgcaacgaaagcggtcccgatcacattcgccttttgtcacgcgcatgcgcggcggaaattctttgagctggccgatatccagaagaatgcgcgggatcgcaaacggaggggcaagccgatctcgccgatcgcattggaagccgtcaagcgctacgacgaattgttcgagatcgagcgccagatcaacggattgagcgccgaagaacgactggctgtgcggcaggagaagagcaagccactgttcgatgacatgcacgagtggttgacgaaggaacgcgccatgctcagcagatcgtccgaggtcatcgagccgatcgattacatgctcaagcgctgggagggctttgctctcttcctcaaagacgggagagtttgtttaacgaacaacgcagccgagcgggcgctgagaagtgtcgcattgggaagacggaactggaccttcgccggttctcagcgcggggccgatcgtgccgctgtcatgctgaccgtcatcaccacctgccgcctcaacgatatcgacccgaaggcatggcttgcagacgtgctggctcgcatcgccgaccatcctgtcacgcgcctgtacgaactgctgccctgggagtggaaacgtgcatcggcggcaaccgtcatgctggcggcctgacgatggtggcttccgtcgtccgcctgaaggtcaccctcgatcatgtcgagccgatagtgatgcggcgcgttgtcgtgccgttcaccatcaggctcagtcggctgcacgaggtgttgcaggcggcgatgggctggaccaacagccacctttacgaattccgcatgcgtgacgtcggctttggtttgcctgacgaggaatggggggatggtccgatcgatgcccgcagggtctcgctgctgtcggcagtccaggacaccggtgcgaaatcgttcaaatacctttacgactttggcgacggctgggaacacagcatcaagatcgagcgcacctttcctgcggtcggcacggaaggaccgatgcttctcgaagcaacggggcactgcccgcccgaagacgttggtggtccatggggttatcaggagttctgcgaggcgcttgcagacccggcgcacgagcgacatgccgaaaccctcgaatggtgcggcagcagcgattatgattccgccgccgccaacttctcgcagctcaacaaagccgtcgatgacctcgctgcaaaatgggcccgaaaagcgcgccgcaaaacctgaacgccgggctgtggccgaaggccgaaagttgattttaccgtgtaaacaaccggcggaacagttcttccgagcgccgtagaccttcgtccgtcagcaccagcgacttcgacttgttcaccggatcacagatcagtcccctctcatgcaaccggtccgtcgtcgcccagtcaaatcccttccaggcgcaacgctcgttgtggagcgtcagccataacagtgccagcaccgcgtcatcgattttgtcctcgtcgatctccattctgctatcctaccacgcgcgagacccccaagtcccgcggcccacctcggatggatacgataagggcactcgtctccatagacctcttcgctgtttcgccggggaaacgggatcgggcgagcggatcctgctcctgcgccggtgattggcaacctcggctctgtctagagcgggatgattttagatccgtcattggagtgcgccccttggggtggacaatggtcaggctgctgatttgccagtctgccggatgtgttgatcctcgaactgttggtgaatgcctgcgcacggcagcgctcgatcagccatgcccgatgctcaccggcgatcgcccgcggcttgtgcccgcccatctggccggcggcggcgctgcccgtctcacgccagcgccgttgatcgaaagtcattgtcgatgccgcctcggttgcggtggcccgccgccaccgacgcgccaagaccgatcggctcgatggcgaggtactggtccgcaccctgatggcctggaagcggggagaaccgcgcgtttgttcgatggtcagggtgccgacgccggaggacgaggatcgtcgccggattggccgggagcgcaaggcgcgggtcgccgaacgggttgtccatgtcaaccgcatcaagggcctcctcgtcagccagggcatgcgggactacgagccgttgcgccgtgatcggcgtgatcgccgggacgaacttcgcaccggcgatggccgtgctccctgcatgaaggcccagatcggccgggagctcgaccgtctcgaattgctgctcgaaccgatcaaggtggtggaggccgagcgggacgcgctgttggccgtaccggcggcgaatacccggcgccggtgacggcgatgttgctggacctcaaagggatcggtccggagttcgcggccgttctccgtgcggaaggcctgttccggcattccggcaaccggagacaggttgccgcttatgcggggctggcgccgtccccatggcgcagcggatcgatcgatcgcgaggaaggtgtctcaaaggcaggcaatccgcggctgcgaacaacgatgatccaactcgcttggttgtggttgcgccatcagccggcatcgaatctcccccgctggttccaggaacgggtcgcgcgcaatgacggtcgcctgcggaagtcggcgatcgtcgcgcttgcccgcaagctgctggtcgcgctgtggaaatatgcgaccgccggcgttgtcattgagggggcggtcatgaaaccagcgtgacgacacatcccaatgccgattccgcctaaatcatcccgctctaagagttcaagccgtctccgcgagctcgatatacatcatgccttccgtccataagcatgggcggacgttgctcgattcgaactttcaagtctgccaaagcgccgggaaggatgagacccttcggagtagcatcatctgccgtgacaaaaactgggtcaagcaccggacgacagcatttgaaatgaacggcagcgtcctcgatttttatcgagggggaaaaatgaggttcgcttccatcacctcggataagaacgatcttcccaccaagaggctgagggtaggaggcaaaaacagtgaaggctgttatcccatcccgcagtccttcgtcatctaagaatagtgcatgcgagtcatcaaagcggatcatctgcaccagtcggcaaccgagcagactaaagattggcgcaagtccggtgccgtcggcaacctcgacggtgcgaaagagtgtcgtctccgggtctaagaggtatgcgacattcttcatgtcccagcctttctcattgtcataaatggcgtgacccaacaaaaggcatccgtcacaggatcaaacagcggcgtgaagcgcacatcgggtggtgtttcgctatgcagcatttgccaagattgggaaaatcgattttctgtatggggcctatccacaccatggaatgtgggacggattgcgttcaagcacatcagtgtattgcgcttttggttttaattcacgagtgactgcgtgtgccggtccagtcggacaatgattccgaaacgaagcgggccacccatttcgatttcattccggtgattccgacgcgaagccggacagtattggtgagccctgggtcgttgcgatatgcgcagttggtgttgcgcaatgattcgtctgctgacatcactgagctcaacgcgggaggcattgcgaagccaggctgcaacgccatagccgagcttcttgccacgatggcagatgacaagcaccgattgacggtagaccggatcattgcaatcatcgcacgcgaaggcgcttctgctcgcacagtggatgggagcgagcggtccgtcaagcgcgcggatgacttggccgatcatgatctcggaggccggcttcgagaggcgaatacccgccatgtggacccttcttcgaacgcagagtacattgcgaagctccaggaggatcgtgtcgaggaacttcttcggaattttgttgcgcatggcgatttccgtcacgaacgtcgttcctggcaggaggcggacttttcccgtctgggtgccgatcagacgctcgatatcaccgccgaagcggggctcaccccggcggtcgccatttgattgctgaccgtaggccgccgcgtcaagaaggtcgacgccggaggcgcgagccggggcgttgaacgccctctcgcggtacacccgaagtctctaatcgggaatcaacttgcggcatggtacggtagtcatcgagatccgcctccttcagcaagttccaataatcgaccagacgccaagggctgtttgtcacgattcggcctcggtcgttgcggaaaaaggtggacataccctcatggctccagatcatctgctggtgcatttgttggattttccggttgtaatgttgatatatatcttgccggcattctacttcgacaagtctcttctcgcccatctggcgcagaacacttagtacataatcgatttggctctcgatcgtgaagatgaagctgccgcgatggccgagcgccgtattgggaccatagagcatgaagaaatttgggaaccccgccacaacggtgccaagataagcctgacagtcatcatcgtcccagacgtcgcgtaccgtccgaccattgcgtccgattacctcaaccggaagtagatatcgtgtcgtatcgtagcctgaggcgacgataataaggtctgcctcatgcgtttcatcatcaatcgcatggatcgacctgccctcaacacgcgcagcagctccgtctaccagcgtaacatgcggctttagtagggttctgtaccagccgttgtccaggagcatccgcttgccgaatggagggtacgacgggatgaccttggcgataagatcagggcgccccgccagctgtccctcgatgtattgtgtgtaagcctcgcggtcgcggtcgttaaccgcattcacggaacggtccggatgcggccaggccggatccttctgcagggcctcatgcacttcactgtcgtaaatccaactcaggcggagcctgtacagccattcatagtgtggcacctcgcggaacaagaactgcatcggttccgggaccggtttttgaaatttcgggaagggcgccacccattgacgtgagcgttggaagattgtcaacgcacccacccgatctgcgatggcgggaacaacctgcattgccgaagcgccattgccaatcacggccacacgtttaccgtcgagcgcgacttctggatcccatttcgaggtgtgcaccaccgggccgtcgaagttgcgcaggcccgaaaggttgggccatttcggcgtggtgaagccccccacggccgagaggaccacattggtcacgagggtttcctccgtgccgttgggcaggcgtaaccgggagtgccaagttaggctctcttcgtcatagcgggtgaccaggcactccgtgccgtagcggatggaactctcgatcccaaagtcgcgggcaacacggttgaaatagtcgtcgatttccttttgcaacgggaagaacgtgctccagttgccactggcaaaagtgtacgagtagagatgccccggcgtgtccactccacagccaggatagtgatgtgcgtgccagaccccgccggtgctgtcttgcttttcgacctggatgtaggaaatgcccaattgtcttaaccgaattgccgctgcgacaccggacatgcccgccccgatgatgagtacacgaaatcctttcggcaaggacacggggtccggaatggcgcctgcatatctccgtagcttatgaagcatcatgtcagcgtattctggcgggataggctcggcctccgacacagtcagcatgcggatcaactcttcttccgacaggtcctgcttggtgactggtgcgccgctgtgccaacagatgatggcgtccagtgctgcattacgaatctccgtctgtaattcggccgcgaggccccctgaatcgttgtcgccccagacactctttacgggaagaaacggtggggtgagccagtattcttttcccgtgaactgatacagaaggagtaatagggttggaacattggccgaagggagtgcctcggcgatgcggtggcggaacagggcgaggtccgaagagtgagccatgatttaagttcctcctgttgcatatatccactcccccgccagacgctaagtttactgcctcggcttcggcgtggttgcggcaatcggcattagggaagatccgacaagcaagctgccgaatgtctgatccaaatcgcgcttgataaagcgagtcgaaggtcgccacggcggggaggttctcgggcgccgtcgtgccgccggccccggctcgactgcgaaatatgcccctgtgctgcctcggctcgaccaggcgcgcgcagccggttacgtctgcatctgaaacgatccaccccttgatgatcggaaggcgggctcggcagaaaccattggctaacatgtcgaaatctctgcgcgataaggtgggtccgtgacgtgtcctgcaaatgcctagaagcaatatgcgtgccaaaagcaagaactcttcttaatgcaacgaaatgactcaagcagcggtctcgcgtgtccaacattgtcgtacatcggacgagcctcaacctgacattaattgtaacactgtatgtctgtcttcgtggccgagtggctcgtcctacactgcacttccgaggttgctcggatgagccgacccaatcctaatcataggaggacgagccgtggcagattatcggctacgccgcatcagcgtctggttgccgatgcttggacgtcagatgtagcccgctcccgtccgcaggaaatctacgccgggctagatcctgtcctgctatttgcgcgatgtccgcaccgtgcaggagcggctcgctgcgcttgccgacactccgccggccatgcgctctgacggggtagctcagccgatcgaccttttcctggcgagcttgcggacggcctggaaggacggagctacccggccgacggatcgtccgattgtaaaagccaaaagaggacggcggcgtcctgaccctctcgtcaaggcgaccgccgacttgcgaagttggttcgaagccgaaccatggcgaaccggcagcgaatttctgtcacgcctgcaggccgagtatcccggcgattaccccgacaagctgcttcgaacacttcagcgccggctgaaggtctggcgcagcgaacaggcggacgcgttgctgtttggcaccttgaacaaggagctgccggcccagcagatcgcaaggccacactgaggcgacgccgtggcgctcgcgaaggaggccaggcgctgcgaaacccctaccatcttcgcgcccggcctccttcgccccaacgcgggaacaaaatgaatgaggcaacgtgcgaatctcgggaagcatcgttacgtgcggcaatacggatgtaccagattgtcgctccaccgcggctgcatgtcggttacaactgggccagcggccagggcgcggggcgggaagctgctacgcctcaattccgaccgggcgagatcttcggccgatcgggcctgcgcgccccgcgatctgcggccggtgctccaccaaggcgcagaggtcatcgtggagcaccggctggaactcgctgcgcctgttgcatcccgagggcgccgccatcgacctcttttccgcacttggctcaggcggagcaggaaggcgaagtcagcgtgcgcatcgacgaaggcgaggcgccgctgagccgctggtcccagagtctcttgacatcactcctggtcactttctgttttgtttaattcaccttctgcaacacgtgaatggctgagccggcgtcgtctgagagcacatctattggcacaaaacccgctcggtgtgcacattttttgaaaaacgactcagagaaacaaaaagagttcttcagatgcagtcgctcgccacttaataggatgatatccttgccgccaatgcaaaagtccaggttctttttgaccaccgctgtatgtatgacttgcatgaattggtctccgcctataacatccggctcatactcaaatgcctctggatcgaaattgccgtcgaccggcagctctgccttcattctatagaacacatttagctgaaattcaggatgcgcttcatagtaggacttcgcgacatccctcctcaaatctgagccaattgaaatcgcaacccagcacctcttcgcactattcgatatcttcttcagcgtctcgacgaccgcttccatggggtgcgtatcatttgttgggacagcaagatttccaaatgtccggccaaacatgacaataaatgccgcttcatcgtcgcaaaaatagcgtcgtccagagaatatatcgccgcgtatgaactcgattttcaaccctaaagcggatgacaattgtgctatgtccccgaggaattctcttgaccggtcgacgagcgtgcaacgtgaggtttcgcctcgcagacctataacaagcggaagcgttttctgttggaaggctcgcactgttccaggcccatactccagaaccgaaattcctttacgacatcgttcgtcctggtgatgccattgaacataatctctgactctcccgtgaagtttttgggctaacttgagttcagcatccaccatattggttgtgccagtgacgagcgcactactgatcctctgggcttcagccttagcccataacaacgcgccactcattggattgccattccggtcgactccagtgtggtgagcgtattgttcagcacctaagtcaggcgcatacttttgccgaaacagctgcaaacttgtttcaagaaagctcaagcttatcgcctctcgattctttaacggctcgtcggatccccagttgacgcacttaccgccgcaaacgaagatggtgcgcgtagtccatgagtctgttcatggggtgttcactgaacccataggagaggctacagggttggaaggagtaatccttgacgtggatcaaagacaaacccgaatctgggaggggcttgaacaaatgacgctggaaggggcgccctgtcgatcactacacgatctttcgctgggctagaaatacgcgccggagatcgaaaagcggctgggttggcaccggcgtcggctgcagtcgacaagttggcgcgtgtgaaagtccgtggtcaatggacatacctttaccgcgccgtcgataaaattggcagcacgatcgactttttatctgtccccggcgagccgtcgatctgaatgagttcgccgaagcaatcgcgccggccgcgcggctggaaaacccgcttcttgcgttcgcgtcgcaacgcccagatgccggcttccataatccactgacgcagcgtctccttgctgacggcaagccggtggcgttcgatcagcttctcggccgccagcgtcggtccgaaatccaggtaatgctcacgcaccaggtcgagcaccaggttgcggaattcctcgctgtggggctatatttccggaaggccgccagccaagtaatgaaatgcaacgcgcttgttcagccgagccgcgcaatcttcatggagcgagtttatccgataccatttagcgttgattgtagacgcaaagttgctaatctcgcgttcaaatggaaggggcttttatgaaaactatggttgcaatgcttcttgcagcggttggcgttgcagtcagtgccagcagcactttggcggttaatttctgccagtccaacaaagaccggaattgctttaccggcagtttcggacttgtcgacattcccggtgacgcaagccataagctgctcaaggcagatttcggatatgtcgatttgaacggagtgggttggcagaccaacaaggagacgaagactgacggcgcttcgattccgccgctattgcaaccgtttgtcggttccccatgggaagacggctatattcgtgcagccgtcatccatgactggtactgcgacagacacgttcgaacttggaaagagacgcatcgcgtcttctatgacaccatgctggccagcggcttggagaaaccgaaagcgaaattgctgttctacgccgtctatgcctttggtccacgctggggctatctcgttcccggagagaagtgtgcggctgggaagaactgcatccagatgacaggaaaggacgccgcgttcgtgcagttgcctggggaattggccgatcagtcgagcgcaggcgaattgaaggcgatcaaggcgaccatcgatctcaaggagcgttctggtgatgcgttaacgcttgatgaacttatggcgatcgccgacgaagctcaccccaagcaaacacttcgtgatcagcggcctgccggtggtgatgagatcaccaagtaacggtgcaagtcgtcgatggaggacgcgaggaagagggaccgtctttcaagaccgacagcactatacgatcttgagaagcagattcatcgcttcaaccggcggccaagttaggcttcgtcaactagcggaaagtctcagttggctgctgaagttcgcagcgcacgagtctttgctatttccgatctacgacaggctttgcgaataatcgcgcagggctccgaccttgcagtaatgtggcaaggaaggagggacggcgtgaaaccagggtgtagagcgaaggctcgtcggtccgggtccacggcgcaagccacacctggcagttcgcacccgcggcgccggcgagggtactgagaatttctcggaccagagaggtatcaagtttggtggtgcgggcgatgcctgcttctgtgcgcaagtcgaaagcgggatcgagaagagccgcgaggacggcgcgcacaaagtccggccgtaagtcggccgccgggagaggccagccttcgatctggtcgcgcatcaccagctcctgcaggagtgtcaggcggatatagtcgacgatcctattcctgccgacgagcagcaggaagttcagcccgagcttcatgcgagcgctcgtcgtctcggtgctgacaagacgccgcgcgacggcgaccagtcgcgcctcgatgcgtttgaccagcaatgcgaaggcgttttcgtctattcgcgcccagcgaggatagggcacctccggcagggcatcgccgacgaggggaatgatcggtacatagtcatgcatgctgccgtccgaaagggtcttgctgatcaccgcgtttcgccgttcggctgcgccctccggccagtgtagcgtctgatggttcttgtcgatggtgagatggcgcatcaagaaatattggcagttacggcggccgagctggtagtcgtggtcgcggaacgcctccaggacgaaaccgccgaagccgccgagcaaaccgcttgcgatcgagaaggtctcctcccgctcctcgccgccgggcgtactaggcggcacgcggtgtggcgagatcatgaaccggctgtgggtgccttcggcggcgacggcgagcaactgatcaggcttgaagcgtacctgctggcggagcgccgtcaccacgcgcctggcaatgctgagcaccccgagcggcggttcgccatcgccgagaaaaggtggcccctcgggaaagggcgcgatcatgataacggctcgatcggccttttcggcgttccgttcattgggccggggcgggtccttcatcagggtgaagcggacaaattcgaacgggtcgttgttgatgaggccaccatcgacagagacgaacgaaaagggatagtcttgcgacgccgagacatgccacgcgtccggccacgtgggtattggtctgagctctgattgatcctcggaaatcggaaacttcgcctttgcatattgcgaggtggccgtcgctatcacgcgcggtgaaaggccaatcgggaaggcgccggaggcgagggcggcattggcgaaggcaagccattccggcgggcgcgtcgacgcgcccgccgcgccgaacagtgacgtggccgcgatcgacgtgcccgaatctgtgtcggcgaaggggctgggggtcggcttccacgtgccgatgccctcgaccacgtagtgcacgcggtcggcgtgcgtcatcatgttgtattggccgccgttgaagtgaatcgcgtaaggcacgccgcgcaagttcgacagcatcatgtagagatggagcgaactggcgacataggcgcgtgggctgagggtacccgtcgcctccaacgcctcagccccaatcgcggtcaacacgttggcgttgagaaccgagatgaccggccgcccgcccgccaggtcttcgagcgacagcaggtcgggtgagccgtcgggggaaaccagcgtcgggctggtcacccaggaccggtaaagacgtccgagagtgaagcggatgttctggctgccgggggcgggacttgggaaggtcgcgggagcctcgcggccgccggcggcgatcacgccaatggcggcggtgatcgcgccagcagaggccccggagagcgccttcaggcgaacgtcgtactccggcaagtcgggagcaccttccgccttcgccttttcccatgcgtcgagtgcctggatcagaaagtcgaagacgccggccgaataggctcccgccgaaatcgcacccgacatcgcaatgccgatttcgaacgtaggtttagagccgtcggtcatcactgttccctcagttgagcggcgccgcattgatccctgcgggcgccatgacgttcgtgcgcggctgccgccggctgcttacaatgtcttcaggtatgcaatgagcgccgccttctcatccggcttcaacgccgggcctatgacgcccgggccgggggtgtcgctgaattcgtgaccggcattgctgttgcccggctttgcggtgtcgaacttgaagccacccttcaattcgtccgttagatagccaagcttgtccgggtcgtattcgcgattgccgagccagaacgtcttcggccgttcgccggccggggaaagcagggcatcgatggtcggcaccgagccgttgtgcaggaagggcggcgtcgcccagatgccgtcgagcggccgtgccttgtaggcaagcggcgcctggatgccgttctggcgattgccattcatgatctcccgttgctcggccggcaccggcggggtctggttgtcgtaccagcgagcggctgtctttgcgacgagcgcgccgagcgcgctgccgaacgagtcggtgtcgatgccgagctcggagggaagcttgaccttgcgctccgccatgctttgggcctgggccggatccgtgccgatattctcgacgttgatgatgggcacgcggagatagcgctcgccggccgaattctcgttcgtccagtgcttctgctcccaaaagccctcactgccgaccggtggcaggtggcagccctggcaccggtcggcgtaaactgcggcgccctcggttgcgagtttggtatcgatcgaaccgaacaggttggaaggccaacgcgggggacgcaggccggtgaagccgttctctgccgtcggttgcttgccggccaactgctgctcgatctcgaaaatcgtgtcgaccttcaccgtcgaggcaaagagtggctgctccgacttggtgagattgatgaaggcgcggacccccaacgcttcgcccgcattgcgcaccatcggctgcatgatcgaggcattgtattggacccaatcgaaccaggacgtgtcccagatatgtgggaaagcgactggcgcggattgagcgacgtagttctccggccgctcaaggtcgagcgagaagacctggttgccgatccggttgagtgcatccaaccggccgaacccctcttcgatacttttttcggccaccttcttgtcgagatcgacttcgatcctgccacccgcaagcaccttgtcgagctgtttcttgagcacggccctggctttctcatccgcctgcggcccgagcactgccgtggcgaagcggtcgaaacggaaaggcgcatagcgggtgaagaacaaggccaatcctgaagccttgcggaattttccaagatcggtgagtgccgggccgccatcgaccatcacggcagtacccttgtaagtgaagcgaccggtgtggcatgccgcacaggtgagcccgacggtggtgagcggcttgccggtcgccggattgacccacggttgggcggttttgggatcgacaagatcgccgccatgggcaaagccgaccggaaggccggatgaatccgccgtaatgaagccgaagcggtcgagataatcgctggacaggaagggcggcccggctgtcagcgtgaaggtgggctgctccaacgccgccagccattcgtagggcatcgagaaggtcaccgtgccctggtcggcatggtgcatccaaccgcgttgtgattgtgaccagttctgctcgagccaggtgaccttgtccaccttcggatagtcaggaagatcgacgctaaacatccggaccacataatagaggccggctgcgaccagcacggtgaacccgagcaggataggccaaaatcgcgacttgcgtttcatgcgtctttacccccaaagcttgaaagcgccccttccagtgcggcgtggtcctctaattattctggggcggcggcactgccgcccgcgccgctcgcgcgcccggatagacgattgcgcgtgcgtgaccgagcgatgcgtaatcatctggactggtcgccaaaggaatgcgaatgcattccgggctccggtttggattcatctccagcctgctcacggccgcctggtcgtcgatgacctcgttaaggcgaatttcgaacatgtccacccaggggaaccagtattcgttccacggctgggacgggtcgaacagctcgtgattgccgaccggcggcggcggcgtgtcacgcagctgcgcctgcaggatgtagcgcacgtcactgtgcctgacgcggtgaatgaaatccttgcgcaggaagtcgggagcccgatcgtcgtcagcctcagcgtccatggatggatggccgttagccttgaattcggggcgcggcagaccgcgatcggggccgcggtcggcgttgatcagccggaagcggacgtagcggctgacgccagttttgtcgatgaattcgaaacagacccaggtgtgataccgcgaatccgtgaacgagccgcggatccgatacgcctcgcgtagttgatcatcgagcatcaatccggactcgaccagctttattcgttctgcgtccggcgtgtggacgaaagtcgagaagtcgcggatgctgcgcacgaagagctgccggccggcattcatcagaacgtcatagaatccgtcgccatcggtgctggcacctggctcgaaaaattttatcgaggcggcaaccccatcgcgtgcgcggtcgtcggcgcgaccgcccggcgaggaatggcgcaggatgatcgggaagatacggccaggcacgaacatgtcggtttcagggaaaccggccggcgtgatgcagcgcgcctcgccttttgccacgaccccgtaggtgtgcgtcgcacgcccctgctgaagattggcggcgtcgcctgcagcttggcaagcacggccttgaagtcgtcatttatgccggcggtcagttcctcgggtgaaaggcgcatgttgaagctccagtgttcgttgccggtcggctcgcggcgaacgacctggttggtctcgtgccggaggccggagctgctgagatagacccgccggcggacctcgttgatctcgccaagcggccggtgttcaagcaaggcgtgccacggcgtgaaggagaggttgtccccgaaggcgagctgcgccgccgaggtgaaggtctgcggtggtatggtgatgcgggcgaccgcctcgaccggtgtcgcccattcgacggtcgggttgtcgatggtggttgcacttgtgtcgtcgttgagctggacgcggaagtcgaagaccgccggtcgcgccgcccgggtgaggtgatcggtcatcgcttcgcggagatagccggggccgcgggcctcggagggaatggacgagacaaggttgtcctttgagggaaccacggaatagcgacaggcatgcgcattgcccaatccgtaagcatagggcacctggctccagtagcgtgcagcaagcgggctgtcctgcacctgctggcggaagccgagaagcacgggcaggtcttcgggccggttttccttcaaccatgcgatgaaggcgagcggcggttcaccgcgaggcgccgaccgcgcgaattcggccatgaaccggacatagtcgctggtgtttctgatgaagaacaccggcttgtccgccagcacgaaatcatgggtggcggcgtcctcctcgccttccagtatctttcggccagccaccccggtcagcttgatcgccatgccgtgaatatcaggcttggtgtcgtcgatctgagcgccgttggaaaagcggatataggccgtgtagaccttcggctcggcgaaaagcccgaccctaaggcgctcgggaaggtccgcaagcacctcgaaggtcgcaaaaacgcagccatgctgtttaaagtgctggccacgcaggccggggccggtgccccgcatcagcagccgctgcaactcatcgatttcagcgatcccggcattgacgtcggacgaggcagtttcggtcattgcgccagtgctccaagctatcagtggggtgaacgcgagcccgcgctagcgggtcttcagatattcgatgaggtccttgagggcatcggcatattgcgggccactccagtcgagtcgacggagcttgccatcgaccacgagattgcggtcgtggcccgtgccagcatggccgtcctttcgcctgtcgtagatggtcagcgtcggcgacgtgtcggcaacgaggccggtaacggccggatccaagacatatccgactttcgcagtgtcgtattggatggcgccgcgcaggaattgctccgggcggctcgccggcaccaggagatggtacagcgtcggaatggaaccattgtgcaggtagggcgcgcgcgcccacaccccgtcaagcacctcggcgacatagccctggaccgccggcgtcgtgcgggcggtgatcacgtcctcgcccgccatccggcagggacggacttcctcccccgtcgggctgcgatagaggaaatcctgatcgtggcagcttgcctgaaagccggcggcgaaaaggtgaaacgccgcgtcattgaggacggccgcgcggttcatgtccgtgcctatatcgcggaactggtagattgtgtcgttgtgcggcttgtggcagacggcgcaattgtctttgaatagcgcttcgccgcgcacggcgctcgccatgtcgacatcgaacgggtaggcggccggtggcaggccgtcgaggaaattggcgacaacgccggtattgacgagatcgatcttggaagggtcgccgacgatcggaagctgagcggcgatgttgcgccagaacgccatcttcacgctgccgtcccactgggcgagcgaacgctcctgttggttccacacgctcggaatgtcggtgatggtcgcaaatggtgggatttctggatgcgaactattcttgaatgccgtggcatcgaagttccggttgaggccccccgccgcgttcggctgacattcgccggggggcattgccttggccaccaacaactggaaaatgagatcgccgctgccatcctgctgtccggtgctgaagccggaaaagccaggtccgttccagttgccgtagctggtctgtttttgaagctcgatcccggcttcgcgctgaacggtaccgcaagcgaacgtcgccaaaatgccgggaagattcttttttaaagcggctcgttgagcgacttcgacattcggcgtgaaattcaggaatccaggtttgccgaaataagccggaggatagaaatacccgttcggtttggcatcgatgatggctgcgatgcgctcggccgacgcttggatcttttcaggggtggagaagtaggctgtcaccgttcgcgagtaggcatcccgccacttgcgcacgtccatcttcgtgttcggcgcaccctcgacgaccgccggtccatccggcgtctgtacctgtccaatgtggcccgcaggcaagcgtcacgacatcgagcccgggcttggcgaaatcaatctctcctaacggattgccgccagcatccagggggcggcccgcggtcgaagcgatgccgagcccgagcggcagcggccgcgatttgtcatccggatcaggaaagaagccgaaacgcccgaaattctcatcgtttcgcccccaaatttcgggtgcgagatcgggtaacacgcgctggagcaaatacggtgcgccagtaaagccattgcccgcattcgcgaaccacgacgagccgaccggattttgctctcggtaggcggtccgttcggcatcacacccagcgcgaatctctgtccaactgattgtcatattcgcactcaggtcatctcgcgccgaacaggcggggtttgctgcagccagcccgtggctcccgaggatccagagcgacgcaccgtacgccaccgcaaaaaagtgcaaagcaaaagggagacgttcccgacagtgagacggcattctaacctcggtctttgcttgcaaggagcagatgaattgggcagactttaagaaaggctgtcaggtaatggcgcgcccagatggaaatccccgccgccgttttacacgcataagtattagcatgggctgggaggattgcaagcctcaaaggagaggtcttttgcgtgttctttagcttgacgctgctgctttcctttaggttaccaatgaattaagtaccggacaatttctccacgagcagggcaacaatattcaaggatagatttgtccaggtgtcggccaaaggatgttattataatactaattcgacttaaacgcgatctccgggtcatctgatagatcggaatataatcatggcgcgctggcgccgagttcaccagcaagacgcagagcgccagccacgtcaagccgctccaatccagacgatatcgtcccgcggccccctcatatgatgagttgaaggtcaagagggtgggggcaccattttgcaagcctttctgtcgtcgacggtatccagctgcgcccattcccagtactggcaggccatgcctcacctgtaccacctcatatccggtcgccgctcaagacggctgcaccataatcccgcattcgggggtgggctcaggagaacggaaccattcttttaggcggcgatagaagccatggggggcttcggtccgttcgcctggatccgtcagagctgttcaggctccgagggattggcttggtcaaaaggtgggtggtcaggccttgcccatgacggctccttcgatcacgacaccgctggtcgcatacttccacaaggccacgagcagtttgcgcgccagcgcgacgatcgcaaccttcttgccacgcccgccgctgtggctgatccgttcatagaaccagcgcgtcagggccgagcccggctggtggcgcagccagagccaggccagttggatcatcatcgtccgcagcctcggattgcctgccttcgagacaccttgctcgcgatcgatcgagccgcttcgccacggcgaaggcgcgagacctgcataggctgcaatctggcgccggttgtcgaactggcggaacaatccctcacttgccaggatatttgcgaactctgcgccaatgcccttgatcgccttgagcattgcctggggcgcggtaccatccaccttggcacactgggcatcgcgctcggtctcgacagctttgatctgctcgttcaccaattcgaatcgatcgagctcacgactgagctgcgccttgagatgggcaggcaattgccggccatcccccgtccgtagttcatccaagcgttcacgccggtcgcgacgcgtaggctcataacctcggacgccaacgctgaagagcagtcctttgatccggttgacgtgtcttttgcgctcctcgatcagcgctttgcgctctcgcccgatcctgcgacgatcttcatcgtcaaccgccgggactcggaccatcgaacaaacccgcggttcgctccgcatccacgccatcagcgtgcgaaccaacgtctctccgtcaatgcggtcggtcttcgcccggcggtgccggcgcgacaccgcatcgaggccgcatccacgacatggctcgtgatccagtcttccgcctcgagcgcgcggtggatccagaaaccatcgagccccgcttcttggatgacaatcaggggatagagcctgccctcgcgcgcctctgccttctcgcgcaagaggttcaagcatgccagcaaagcaggcaagtcaccgccgggtaccgaatgacgcgacatcttctcgctgccaggcgatagcggcgtcactagccagatcgacttcgacagttccaatgaaacgaaaactgcgtcaagatcaacccggatagcggcaggtggcgaagctggttctgctgtcatggcaagtcccttcagagtggttggtagcaaaccgactctgatctctcacaggccgctgtccaccgctcatcatggaatctttcgagtgaaactccgctccgggaaagcgccaatccttgagtttgatcccttgctggcaggcggcggtgagcgaacggtccttggcggcctgaaaaccaagaatgtcgacgtcgtggtcactcgagaaggcatcggaccggttcttgccgtttcgtgcaaggtccggaatctgacgaaccgcatggaagagaccatcggtatagcgcggcgatcaggatgagacggcggcgacaatctggatgagactcttatgtcgcggtcggcatgaaggtatcatgttgattgtcgctggcaagggtctcatcgtgttctgattgtcgctccgcgacaatcagggaagcacttttggttgtcgcgaaggcggcgggtctgccgcggtggcgtttggcttccatggcggaacgtcgccgatagctttcgacgttcatttcgaagatcgttgcgtgatgaacaagtcggtccaccgcggcaagcgtcatggccgggtccggaaagacgcggttccattctccgaagggctgattggcggttatcatgatggaacgccgctcatatcttgcggagatgagttcgaacagcacgctggtttcggcctggtccttggtgacgtaggccagatcgtcgaggatgagcagatcgaacttgtcgagctttgcgatggcggattcgagctggagttcacgccgtgcgacctgaagcttctggacgaggtcggtcgtgcgcgtgaacagcacccgccaaccattctcgatcagcgcgaggccgatggcggcggcgagatggctctttccgccgcccggcggaccgaacaggaggatattggcacctttggcgagccaactgtcgccggcggcaatggccatgacctgggccttggagaccatgggcacggcgtcgaaagcgaagctctcgagcgtctttccgggcggcagatgcgcctcggcgaggtgacgttcgatcctgcgatgcgcccgttcagccagttcatgctcggcgatggccgaaaggaaacgagccgcaggccacccttcacgatcggcctgttcggcaaattgcggccacagcgttttgatcgtcggcagcctcaggtcattgagcatgatgccgaggcgggcttcgtcgatggtgttgtggacgtttttcatgcggcctctcccgcataagcagaccccatcagggcttcatagctattgagcgatgcgagctgcacatgcacggtcggcaactgatccgggtccggaccgaagatggctctcaaggccatcaggtcgggcagtttgcgggcgtcgagcgttctggcaagctcctcggccagttcacgctcgcaaccgcgatcatgagccagggccagcaattcgacggtgatcttgcaagcctgccggtcaggcagttgctcgatgagagcgtcgaaagccctgcgatattccggccgggggaagagcttgtcgcgatagaccaggttgagaagcgccatgggctttttgcgcagagagtggatgacgtggtgatagttgacgacctggtcatgcttgccgctcgcgtgggcgcgacctcgtggcaacgtcagcagatgcgtgccgccgatgaagacgtcgagacgatcgtcaaacaaacgcacacgcagccgatggccgatcaaacgggaggggacggtgtagaagactttgcgcaaggcgaagccgccggtgcgcgacacggtgacgactacctcctcgaagtcggtggtgcggcgctcgggaagcacctgcagatgcgggcgctcggcatcaatgcgcttgccatgcgcggcattgcggcggctgacgatctcgtcgatgaaggcgcggtaggagcgcagatcgtcgaagtctctggtgccgcgcatcaggagtgcatcgcggactgcgttcttgagatggccgtgggagctttcgattgagccgttctcgtgggcgacgcccttgttgttgcgcgtcggcgtcatccggtagtgagcgcacagctcctcatagcggtttgtcagatcgaccttggcatcggcatcgaggttgcggaaggcagccgacaggctgtcgctgcggtgatagagcggcgaaccgccgaccgaccacagggcgttctgcaggccctccgccaaggcgacgaagctttcgccgccaaggatgacatgggcgtgctcaaaacccgaccaaaccagccggaagtgatagagcagatggtcgagcggttggccggcgatcgtcacgctgaggctgcccatgtcggtaaaatccgacagccctagtcggccgggctcgtgcgtctggcggaagatcacctcctgtgcttcaccgtgaaccgcccgccatgaccggatgcgccgctcaagtgtgcggcgaatgccttcgggcagttccggatgacgccgcagcatctcgtcgtaaacggcgaccgcacgaatgccgggagcggccttgaggagcggaacgacctccgcatcaaagatatgctcaagcggatcgggtcgacgccgaccgcggggcggcttgttctgcgacggaaggcgctgctctttctccatgcggaacgccgtcgcccggctgatcgacgccttcgcggcggcgacctcaacagaatgcgtttgtcggtacttcatgaataatctcatctgatgatcggttacatggcgacccggcacaaaggtggttctccattccagaaaaccgccaccgtagcgggccgaccgcgatcatgagacgcctaaaaattgcgccgcggcgggggtgtaactccggtcgggctacgccctcccttcgtcacacccccaccgccgagtctcatcctgattgacgctgagtctcaccttgtttgtcgccgcgcaccatcggcgagtgcactaacttgcacatcacctatcccgcactcgtgctgggatatctcgttctccttcgagcaaaccggatgatcgaagcggcactcgatgacgctgcggaagtcgccgaagatgccggcgctgtgagcgggacaaaaacactacgctatgaccgaaggcggcgcaccggtggcaggcatcgttcgcttccacaacgctctgtgtgaactcttcggccggcgaggcatccgtgacaacgtcagccgttacgaggcgattggcttcggtctcgtcgagatgcatggcgaggagcgcaacagcctcctcgaaggtctcccgcaatcggacagtccatttcggctgagtgggttttttgacacgctctacgctcgttacgacgagcgcttcgtcgttagtgcaccgtgagcgtcacgaacgccccaccttttatcggcgtgatttaggcctgagattcggctctttgatttggaagggctgttttgaatggacgagcggaacgatagtgccaggtctgaagccatgtttgaagccaggcacgaagggcggtatcgccgtgttgaggtgatcacggggccagtccgccgacggaactggacggacgaggagaaggctctgatgctcgcggaaagcgctgagccggatgcgaacatctctgccattgcccggcgctttggcgtcaatcgcggccttttgaacacgtggcggcgggcggcaggccaaattggcccggttttgggagagcccgcgctggagcaacccgctttcgttccgatcaggatcgctgacgatcagaatgagcatcaagctgatgaagcaggtatcgccgaaggcgccgccggtcggatcgagatcgagcttggcggtgggcggatgatcgtgacaggcaatgtctctcccgacttggcgcatgctgtggtgatggcgctgcggggtagacggtgatcgggccatcgagggggctgaggatcatggtggcgacccagccggtcgatttccggcgtggcatgaacgggctcgtcgcactggtggggtcggcccttttggccgacccctattgcggcgatattttcgtcttccgggccaagcgttgcgaccggctgcgctgcatttattgggacgggtcaggcatgatcctttcgacgaagtggctggaaagcgggaagttcatcttcccgccggtcaaggatggcgctcttcacatgtcacccgaagagttcagtctgcttgttgcgggcctggactggacacgcgtcaagcgcaagcccgtgaagcgaccaacgaaagtggcttgatctcattgtatttccttgcagattcacgcccgtgtggtagctttcggcatgtctcttcgccacgaacagctcccgcaagatgtcgagcaactgagcaggatggtcctcgatctgagggcggaggtcgcctacctgaagcggctgatccacggcgcaagatcagaggtgctttcgacgatcgatccgacgcagaccagtcttgatctcggcgatctttcgactgttccggtcgccgccaacgacgaccagcctgacggttcccggcagagtgtgcgtggccggcaatccgcagcccgcaatatcggctttcttccgaagcacctgccgcgctacgacgtgattatcgagccggaaagccgcgcgtgcgcctgttgctccggcgcgcttcaccgcattggagagacgacaagcgaagcgctcgatatcgttccggccatcttgcgcgtcaaacgaaccattcgccctcgctatgcctgccgggcatgtgagaatggtgtcatgcaggcgcccgcaccggcgcgcttcatggatggcggcatggcgacgacggcattggccgcccatatcgtcgtctccaagttcgcatggcacttgccactctaccggcaagcccagatcttcgcaggctatggaataaccctcgatcgcggaacgctcggcatctggggcacgcgtgtagcctggtggctgaagcccctctacgacaggctgctggccttcattcgctcgcagccaagggtcttttccgatgagacccgattaccgcggcttgacccggggcgaaagagaacgaaagtctgccagctgtgggcgcaggcggtggacgaccgcccctggaaaggaccggccccgccggcggtcggttacatcttctccgagagccgcagcgcccgtgaggcggaacgccaactggcatccttcaacggcgttcttcaggtggatgggtataccgcctacaagacgcttgccagacatcgcggcaagagcaattccagtcccttgaggctggcgttctgcctggcccacgcccggcgtaaattcgtcgatgtggtcaagttgaccggatcgccggaggcgctggagatcgtatcgatcctcgccgaggtctaccagatcgaacgggagatcagggggcaaagcgccgaggatcgtcagaatgcccgccagctccgctccgctcccgtcatgcgccagttgaaggcgcgcctgctcgacctgaagaacgacatctcaacgcagtccgccctcgccaaagccatcaaatacacgctcgcgcattggacgggcctgaacgctttcctggacgatggaacgatagaggttgactccaacatcgttgagcgttcgatgaagtccgttgccctgacgaggaagaattcgatgttcgtaggcaatgtccagggcggtgagaccttcgcggttctggcctcgttgatcaactcggccaaattgagcgggctggatccgtacgcctggcttgccgatgttctcgaacggatcgtatcgggcagcacgacgatcaaccagctcgagacgctgctgccttggaattggaaagccgatcaggtcggtcaagccgcatgacccggccagccgtttcctatgacgaactcgatgagtaccttcgtggcgatggacacaacgactatgtcggagtgagcgccatcgatgggctgatcgcggccgtcgtggccggcccggtgacgatccttccggatatctggttgccgcacgtattcgggggatcaatgccgcaagccaggccgggctcgatcgaggagcggctcgtcaatacggtgctcaaccgtcacgatgaagtggaaagcctgctgcgcgacgcccccgggcactactatccgatcttcatgaaccacaaaggcaagaccatcgtcggtccttgggcgatcgggttctcccttggactcagtctgggcggcgaggcttgggcgccgattgctggcaatgccaaagccagtgatctcccccatcatggccgtcaatccgcagctggccaaactgctcatccggctttctcctcaggagcggcggaaattgagagcaaccgctcatcatcacatcacatccgcagtcctgcagttgcacgccatcacaagacaggcccgataacaacgcagccaccggcacaaacgcaaccttaccgcaagacggcgtgttcgttgcgcttacagtgcaccagatctgtcgagcacgacacgcaggctcgagggggaccctgcatccccggcgtttcaggtctcaaacttggattacgccccgcggaccgatggtcgggctgccgttgggaacatgtcgtagcttatctcggatctccattatacgagagtacaagcacatgcgcggagggcgccgatcgccaactcctcgtgttgcgtgaggactgatcgggtcaaactcacgaccgcagcgcccaagcgcaaacgtcggtcgggagtagattgaaatattgcaaatctctcactgctgccgtaagccgtctggaggaggggcctgtagctcaatggttagagccgtcggctcataaccgattggttgcaggttcgagtcctgccgggcccaccaaattttttgtgtcgcctcataccgcggcactcgaacatctgcgtcgccccgcgatagacgaccggggctgcctggaaagcagcatatgctccgtcaacgaaacctcccagagatagccacggagcccgaggtctgccgcctggtaagtccaaagggcaactaaaatgcatccctgatcggaaacatgtcttcgccgtagtggtgaagtcgtgtgtgatgccgccggcataaccaccgtaccttcaaaggctcgtcatattggtcgtgatgggcatcgactgtatcgatcccgcagacttcgcacgtttgcttctccagttcgcctgcattcactgcgcgctgcacagcgagatgagcatcatacttccctggattggcacggcgccaattcgcttggcgggtatcggttttcagcattgctgcgctgcccttcgttggcctttgctccggcctgacgaacccttctatcacagtttcgcttcgggcgcgacagcggactgtgcctcgttgacctcaacggcaaactggctaccatccgagtcggcccatcaagttcgccgctcgctccttccggaatggtgaatgcacaaattcatggcttgacccttgtgggcggctcgtcagaaacgcgagcactgacctccattacgccccagagagggaaagaaccattagtgttttcgcacgctcgaaattcatggccaaagccttttgcaaggccctgccgaacaaaatgtcgagctaacggaagctacccacttgccgaacccgtccaaaagcaggaagtggcggaagacggttcttagcacagttggcgtcgagcgcttcgcgtgcgagcagcaatgcatggccgcagcaccgaagccgagatccgcagcatcctctaaagcgattgccatcccccggagcgggtcaaacgggtctttattggcgcctgctgcccttgaagcatggggcttgaccgatgccgaagcggagtatttcaaccagctccgtgacaagactcctgctggaccgaattcgcgtggaacgatcggagacagagaaaaaggccgagcgtgtcatagtggcgccgacattgtcacgcacacaccctgccgccccgtccgcggcaacggcgacgtccgcttctgcttaggtagcggatatgttgctcagcggttcaacgctgttgccgtatttgcgcctataggccgagatgaaatcttcgtcgctacagatgcagcggccgctcgagtctttggctttcgggtcatgtaagtgagatccaaggggccgcagaagattcacgcgagtgcttgtcgttgggctcatgggaaaacccgcactatgtttgaccagctccgcggcgagcatgatcccggcaagcgctgactgaaaggccatcggaaccacggttcgaacgagacgacttccatcgctaagctggaataccagaccgccgcagatagcctgctgatagaaggaacggagaggttggccaacaaacggggcgagcggctcaaaaggcacgcccatcgccgtagccactcgaaccacgaagtcgttgggaacgccggcgttagtctgcaatagcgctttcacctgctcgtgtgtttccggtatcccgagttcctcggcaatcagctgatgctcgtccttggattttccagacggcatgtacatgcaacaaaggcatgcctggccgtcatcgaaaccatgccgcgagatgccgaggtcgtgttcctgcgtccacgcattcgcgatccatcggggcagagcaccttggacagcgagacggtcggcggctgtgtcaagcgccacacccactcgatcgaaaatccagtctccccggcgcgcgacatgttctgcccacttcagcggatgcgcttcgacctctaaagcggtcgatcgaagggcggtggttgcaagaaccgccttggacatgccgatctccgcttggccggccaatacgtagcgctgcaggtttgagagttcgaccgcttcgtggtcgacgacatgcaggcgacccgagaggccggattgtctcgccagagcccaaagcgcgccatggcctatcgcgccgagcccaacgaggtgcgtttcgccaaggtcgacaggaaggtcaaccgggcgagcatcgcgagctttggtcttgttgtagctgtataacgagaggtcaatgtccgggtccaactcggcgccggttaactgggcggcgaagatggttcgaaagacgttggcggcgccgaagcaactggcggcgccagctccataggggagcaaactcgagccagagcccaccgggtccgtacgcgacagctttgccgcccaaccgtccgatccgatgaaaaaggttgtgcaccgcagagatggccgcgtcgcgcctgcaactaggcagaccatggcggacttgccggaacgccgaatgccgatttttggattgatcgactttgccaatcgctccagcgcctgggcttgaaagctcgacgcactgtccaaggggagtattgccagaaccggatacagtctggcaagcaacctcaccgcaagatctagcgtcgcctggccttcggcgcaggaagcggcctgatcgtcgaaggcgacggccacgacctgcttttcaagagccgctttgaagtcgcccagatgaaaatcggtcaggacctgagatgccgccgtcgcggcgcggtcgatgaaattagcaagggccatcgtcaactcgttatcgtgatcattcgcgtcaggaccgcggacgggacctcattccaattcgccttagcgtcaagtcggtaggcggcaacatgagcaaaatcgaaaggctcccgagcgaaattcggcactaccagcgacagacacccaatcgtggtagcgaccgcataggcgtcatcggtcgtcgagtgataggcgcggcccggatgactatggatctgcgccagaagcgtcaggccacgtttgtagagccagacattgagccggtgcagttcttcggcagggaccatcacacagacgccatcacttgttcggatgtggcgctgcgccgggatcactgtctccgctatgacaaaatgctggtcttgctggacgccgacccagagtgccatcccttcatggccctgctgtccaaccgaccgcagatgcgcctgtactgtggacacgcagtctcgggggagggcgactgtcctgacatcctctaacgcgctcattctggaatggcctgaggtggtactagcagtcctcccaacgcgacctgaaggtgaatctgcagttgctccgcagggccggtcccgtatttgatgatcttgtccaggatgaaggccaaacagccttcgccagaaccccgatgaagtagccatgggtcacctgagtgcgctggattatcgtggtattcccggactccagccatgcataggaatggttggtcctcgagactgttggcttgaatgaaatcggtcaatgataccgcgttctgctggataagatttgaaatcatttccgtcggggttccgggcagttgcggacgccttaacatattcaggggaaggtccttccgggcaatcggctgacgtgtaaacggatcgacgaagaccacagacagtggtctgagatcgtagttggtgaagtcgatctcgatggccgcgccgataacgcgcggctttacctttgggctcgcaaatatgaagaaagcgctcgggaagctctcctcgatcagaaagcagccttgcatcctataggcatctgcatatgcgcggaaccggctgatctcccgatcaaacttcgctcgagagaccttcgggtccacagtttggagttcaggcacctgcgacacccgccttcaagctgaggaacagggttccagtgttggcgaatccgaaatcaccgattttcttgtcggcgtcgagcagcgtgccggcctcgtccttgaactcccagttctcggcaggttgggccacgttttgcgtgttctcaagggctttggtgcgaacgacgtgtagcggctggttgggattggcttcgacctgcgtaggctggccgttcaccacgacgatgatttcgatcttcccggggccgcctccgtgattatcgcccttacccgcttccttcgacattgtcatactccagtggcttgccaaccggccccaaggcactactgccgacctgccggtgagcgggctggcggtctttgatcgtccactcggcgccacgaaccgcgagcacgtgaaagacaggggataagctaccgaatcggtgctagggcttttttacgcggtacttgagaggcaagtaaacctctggaaaactgctgatcacaactataatcgattagagcagctaaagtattggcgaaatcttccatgagatattgcggtatgatagcgctggatatataatgctatctttgatatcttcattgaagggaagccatcatggcaaatgtgaccgttaggaacctacccgacgaggtgcaccgagcgctacgcgtacgagcagcaatgcatggccgcagcaccgaagccgagatccgcgacatcctagaaacgactgtccggcccccggagcgggtcaaactcggctctttattggcgtctattgcccatgaagctggagggctgacggatgccgaagcggagcatttcaaccagctccgtgacaagactcctgctgaaccgatgagcttcgaatgatcgtgctcgacaccaacgtcatatccgaattgtggaaggccgagccggaccgcgctgtgttggcctggatcgatgcgcagatgattgaaacactgtatttgtccgcgattacggtggccgaactgcgtttcggcttggcggccatgccggcaggcaagcgacgcacgatctttcagaatcgcttggaaggagaggtcttgccggccctcgcagggcgcgttcttcccttcgacttggacgcgtcgcgaagttatgcggacctgatggcgcaagcgaaaacgtcaggcaaggtcatcggcaaggcggatggctatatcgccgcaacggcggttgcgcatggctttatggttgctacgcgcgataccagtccgttcgaggcagctggactagacatcatcaacccctgggagccggcatgatcccgccgatctcatttctctatgcggtatgttaaaccataatgtggcggccaggttgaactgtccgccgttgggcaaagttaaaatgtcactttggatacgtcttcagccatttagaaatacgacactcggcatgtccacttgcgctgaggcaagcccccgaccgggccggctgggccgggttgcaagggaagggagggggcgggtgaagggcaccccttcggctttagctttctcggtttcaattattgcgttcctggtagatgttgcaggcagctgaatgtgcagggccaggatctcgcgatgcttccggaaatcaggctgatgggtgacgtcgatgtagccgcgctgtcgccactgtttcgtggcatggtcatgactgtttcctacgccgagacccaaggagggatcggtctgaccgcgtcgggggcgatgaaccgcaagttcgtccactgggccgctgttcacttcgattggcccggccacacgtcggacgacttgtacagcgtcagcaaggttctgaacgaagccgatatgccgccgcttttggtcgtccgcgacatgctcaagcacttgcggcttcttcggcggcgaaaggacgtactggtaccaacccaacgcggccgagactttctggtgagaccgcaggccttcttcgatctgatcgcgacggattatctttatgcttatatccactacgggcagacgcgggaggctgtccgcaatcggatgcgttggtggcacgtctttctcaatcttatcaacatgaaagcagaaacgggctgttcgttggacgacctggcgaacgagctatacccgagcgaatcgtacccggagccagcagaaatgactgtcgaaacctgggcggaaaggtcggcgctccgctacgattcattcgcccgctgtgctggttgggattgctgcacgaagagcgcgaggggctgaccatttggcagggcggaacctaccacaagacacccttgtgggctgcctgtttaaagctggaatcagacaggcaatccgagtttatcctccattgaactgtgccgggtagggttgcccttgctccaccgcaccttgctgggaaagcgcctgtcgacgccgagcaatgacggccggatcgttcataaaatccgtccgcttgcccggcttgcggcgccgcggtttgtagccaatcttctcgctgttggtcttcacggtgtcaatcggcgtccaaagacgaattcggcagtgcgacaagtgcccgtggaaagtatcaaccgaccctcacgatattccgcatggctacactgaaacgctgcatcacgcacttgcgaggacgattgccgagccgggatccctgcacgacgcaggacatgtgatggcttgtcatgagcacccaccgggagacgaggccgactgcgtaggctggctcatgaaccaacttggtccaggcaacaacatcccactgcgcctcaaggttcggtcctgcgagaacatagatgcggtcacattggacggtccgcagcatgaacggtttgtggatacgttgcctaaaacccgcaaggaaccagccgattaggtggtctgcggccgcgacgtgagcgcttcgagatgacgagagatcgtaaccgtaccgcgccgccgctttgccgccaacgtgtatgcgatcgcctgatccaaatttccgattggctaggtcagttgctgacaacatggtggttcatcgcggtcgccacttccattttcgagctaagcacataatctgggcgcgacgccggagaccgccactatgacgacaccaccgaccgaacccacctactgcctggcgttggtaaagcccggctcgcggctcgctcgcgaatagaagctgctgaagccgagctacggaatctacgagtacgaccgagccttcgggacgagggagctgcgttggggtgatgggtcctggcaggaactcaccgatgaagaccatgccgatctgattttgcttccgcggctcggcaagaaagacattgaagcgctttttgactactgagagttcatgaagcagcgcggatctatcttagcgtcagctcgcaagaactcggtgcgccaaaccaacgctccgcgcctttcgccccaggaggtgagctggtttttcaaagaccggatgccttggtaagattgacgcggaagcggtcgcgccggcgctgatagttgcgggtcatttctgctgtggcttttgcttcccgatttcaattgaagcggtaagctgaaatctcggccttgattttgaccttacgcttttacgcgccgaggaaggggaggctttcgaagcccggatgcttggtgcgatcgatccgaaattggcgcgccggcgatgggatttggccgtactggcatgcggagctctggacctaacgctcgtcgacggtcgcttgtcccaaattgctgatgctgccgttgatgtttgatctcgcaatcgccgtggcaaaagtggtttcactgaaacccttaggggaaaatcgtccggtgcctatcgtctaaacccagccggcatacgacaatttccggtttgaagtggcaaagcaaaacctacatcgggtggcagtgccgctttgacgttcgaaagcattgcgatgcgagcctatcggccggcgcagaagtgccgatgacgccggcgcgccagaggcggcggatggcaagacgaaggcggtcggtccgacgggttcgatgaagccagcgcgaacgtcgtttgtcgcctcaactctcattgcggttggtgacggacagcctgacgccgtgtgcctgcgaggggaaggggagaggcgccttaggcttttgccgcgacaagggcggccagcggcgcaatagcctggccatcgaggccgaggcgatcaccgagatagtgccagaacgacaggccgagctttttgcaggtcttcatcagcccaagcatggtgtcgcgcgccacgcgcccatcccggctcatcgtgccgccggagatctttcgcttggtgacgaagctgcgcagatcgttctccgacgcattggtgtgcagcgggatatccggccgttccaacaccttgagcagttcgtccttccggcgagaaagacgagccagaagcttgtcgaggtcttcatagccggtgcgcagcgagaagatgcgcgcgaagcgtttgcggaatgcggcggcaaggccgggcgggggctttcgtttgacgctcttcagcgcccggtagaaccgccacacaagatcccgcaccgcctcgacctgtcgcacctgccgcggcgttgccggcatcaatttttgcagcagccgctccgcatagacccaacacagagcatggttgccgactcggaactggccggcatcgtcagagacgatcaccgtgtcgccgagaagaccgtgatggcggatggatccccagatgccggcttctgcgagcacgcggaccgcctgcctgtcgaaaatgtcgatgcccttgccagccagatattcgaggaacggcacctggtcgcaaaagcgtcgtggttcgtggctgcggattttggccacaagcgccggatcggcacgacggccgtccagatagtcgaaggcggcgtcgttgaggacatagtcttgatagctgcctctgagcagcgacaggaagttcagccgggattttgatgcggttgtgcggaaagcggtaaaatgctcagccccgatctgggtggtgtggaagctatcgcgcgcatgccgggcaccggtatcgtcgacggtgatgtagggggccgagacaaggccggcatgcagcacagccgcatcctcggcagcaaagccgtccagtccctgggtcaaaagtcgcacgacctggcgcttggagacgctgacgccgacatcgttcagtcagccgcgccatcgtcacctgtccttgcgcgtgcagcatcaggcagagccgcctgaggtttggaccgtagccgccgacgaccccttgcggcagcggcgcgagcactgtcttgccgtccggcgtgatccaatattcgcgccggtagtgaacgagctcagctgtgacaatcaggtcccgcacatggcagctcttgggcggaacacgggcgtgcaggatttcctgccggctcacccgctttagatcgagcttcgggccgcgcggtttcttcctggtcgcccgcggcgcgtcgcgtttgtcatccgtcgccttgtccatgcccgacgggcgaaacggcggccgtggcggcaggttcttcagccgtgcgatctcgtcgcgcaaaagctggttctcgaccttcaggcgggtgttttccagccgaagcgcctcattgtcttcacgcagggcggcgttctcggcgtgaagggtcgtgacctccgctgaaagctccttgacctcatcgaccagacccgtcacaagcacgcgcaacgccttcagcgaaagcgtgtcggcatgttcgggcgaggcaagtcgcttcttggccatgatcgaaaggaagcatgatttgccccaagcgcggaatcccacccgcggctccgaccctctacatcgcccgcttatgcacagttctcgcagcgcgtcgatgaaaagtccgccacccaatctgccccggttacccgcgaccggtccaaaatctccgcctggcggaaaaataatatccggatcgagagacccaactactcgtcgttgcacacggggtgagcatgaccgcgaaatcggactgaagatgaccgggccggacctggcgcggcagatggtggggcgctagctcgcggggcggcgcacttcgtcaaagctgccggaagtgatcgagtcatggcaaaaccgatcccttcggccggcattggccaccaagacaccagaggtcacgccgcaggcggcgccgcggattgtcggcgaattgggcttgagagaagggggaggtttcgtggaaaggtgcgctttagctgttgataggttcacgtgcgccggtgaatatcgattagaagttgaaaaggctcttgagcgtttcagatgtcgtatgtattcgagatatttataagcgatcggcgataaagcggaatgagtctcttaatggcacatcggaagtcaaaatcatctcagagaaaacttcggaaccggtcgtcatctctaaccccgcaaaagcgccgtattcgggcctccaagggctcacacgacactatcctgagtattcgaaatgaaacttcctcattggaagcacttagtcgtactattcagtggaccctcgcgaggtacaagtatcatcgttacttggtatcactatccccgcggaccccatcgcagctcccggactatgtcctagccgcgaatgatagtctagaaaatgcgatgaaatggcagattgcttcaatctccgccgttggcggcaagatcgcctctcacaataaaaatacttataccagcattgaccagatcactgattactccgcctccttggaaagggcaaatgcagagattcgaacgtgcatgtggagcttttcgtcagcctctcaagctctattttcgctcgcgagaacgaaaggcctcgacgctcaacgtcgatggatgcaaggtagcctttacgttgcaaatccttcaatatcaaacataattctctatagcaaaggaatagcgtcagaaggagatcggcatccatcggacgtacttgaggtattgaatagatttatattctcaaaatttgccgacgaagagctaaatttgctattgtactacctgacatttaaccctcttctgaatgtcgaggtggcatcaaagctttctcctctccttctgtattttcctgtagtcgatcagtatgagtttctagctaatttattcacgtcagatcagagtctatccaaaccagatgttctgccttttgggcgagattttgtcgagattctgtcatctactggagattggcgcgcaagcccaaaggcagcgctcgcagaaagggtcgaaccaagtcgtttcactattcctttgctgaacagatggtgcggctaccttctcgatagtattgggatactggatggagtttcttcggcgcccgatcgcgaatttgacatcgccttagcaaacgagtttttccatcagccacaatctccccgcgcgtatctggcgagctccatttttgcgatgaaatccgctcagacactcgccgacgtcaagtcggcattatataaacgggagatagccaacgtacacttcgagaaagtagagcaacaaattgctccgcccgatcagcgcttcattgactattcttttgccgcagttgccgctgaagtcggaatttcggagtcggtatacgaaaatcgggaactattcagaattgcttgcatttgcgggattagcgagggacgcacgctcgatacgctcattcttctttgcgaatatacgaatgccgatccatttggatcaagttactttcctgcagacctattctccgcgagcgtaactgaagacgaggtggccaggattgggcatgatccgcgggttgctatcgggctttcgcgcgtggccgctagcctcggcgatgaaggccaaaatctggtctacatcgcagttgaacaacatctcaacgttagaggaatgagcaagccgagtgaaattgtggctgacagtgctgtcgacgtcgctttccttcgtgaagcttgtacctcgagctccttaaggcaatcgctagagtttttgtcaaaggccgagatggaggacgaacggatccaggttctattcaatttggctcaggtggatcctgcaaatgaagacgattacatcgaagaagttcacacaatcattgggcagcaaacgattgaggagcttttgcaacgattccatgtaggtaaagtgcagtgcgatgagcaagcgctttccacatgggcgctcatagaattgagtccgaagttcaaccgtctgaaagattttatcgatgccggattgccgcccgtagagaaggacgctgacattcaatttatcgctcatttgacgtcgggaaaatcggaaacatttacttttaaagttcccaataatgagtcgctcgacattgcccgcacgatcttggcggagttgaattcgaaatatgcgttagacccgcgctatggcgtagactcgtacttgagcctggggatgcggcatggcgcggtcgaagctcatcttcagagcccgctcagcgccgagaatattttgactgcgaaggagcctctcggatacccggacgattgtttctggacgaggtatttcatcgacaatggttttgagtgctacggcgagaaaattgggccggtgctagcaacattttcggagaagtttgacaataagctggaggctatcaagaacgatcttttgcaggttcgtcggccggacaaaccagaagggctaatagtagcagattggtcagaggcttcggttttgtcggcttgcgcaagatttgccgaggtacctgactttgaagccttcattgctgagttcaccttgatcttttgggcgaacgtggaaggtaatctggctgccgcccgtgaattcatagaaaacgtgctttcgaacgagctaaacgagttgctagacgaactggaggcaaacgttcgtcaagcaactgggcagcagcgactggcgcctttctcagatgcactcatgcgcgcacgccaggagctcggcaacgctgtcaacgacgtatcgacatggcacaatgtggctcgttctactgacgttgaaccacttggtctggttgagattattagcgctgcccagaagattgtttgccgcctgtatcccgatttcgagccaagagtaacgttttcgggagacaccggcataaccgtaacttactcgctccatatacttattgaagtgtttaaggccttgttcacgaacgtctacgcccattcagaagtggagaacccagccgtggacgtccacatggcaatgacggttgaagacgcactggatgttgaattcgtcagcgactgcaatgatatgggcaaagctgagcgggccgcccttgatgccaatgaaaaaattaggactggggaatacgagaaaaagctgccgaaagaaggaggttcgggtttagcgaaagtggctcgctctactctgcgagacggaaaaccaaacaccgtgatttcagttgatcattccacgtgcaaatttcatgtaaagatggccttcaaaataatacagatatgaggctcaccccgatgaaaaccttaatcgtcgaagataaccctaaaaagagagcctctttggttgaatactattcgtccgagtttccttcggatgacctggaggtgacatctgctttaatatcaggactgcgggtcgcgcgagatactaagccggagttcattattctggacatgactcttcccaattactcgcccgatgaaaacaaaggctcgcgtatcgagctgatgcctttcgctggccgcgagtttgtgatgcgagtaaatcgaatgtctattaagacgaaggtgataattgtttcaatgtttgagactttcggcgtggcccctcgcttgataacgctcaacagtttggacgctgagttaagggacagataccccaatgtctttgttgaggcggttcattattcccaggcccaagcagattggaaaacagcaattaaaaatgcacggcttagcttggatagataaatgcgaattctgatcgttgatgacgaaaataccaaggttgttgaaatctgtggcgttttacgagacgcccaaattacagaggagtcgattactgtcgctacgacagcagctagtgcccttaaagagctcaaggagagctacttcgacttgctaatcattgatatgtacttacctaaccgaattggtgaggccccaagcctctcgggcggggttgatttattgaagcggatcaaccgtgggaacgatgtgcagttaccggaacatatccttggtttaacttctaatctcgaagctttggcggcttctgaggaggatttctccgcgagatcgtggtttgtcgaagaagtagggccatcaaagaccacgtggaagctccggctgatggagaaattgcagtatcttaaagcgcgtgaggaatatcaaggcaaccagtcgaagagcgagattatctctactcgacccgaatgcgaggttctgtttgtttgcgcgctactcgatcccgaattgacagcgttgcatgcagtttctggatgtgactgggaagtcgtaacatttcccggtgacccaggaatctattggtcagctagcttgaaattcggtgcaaatacggtgtcggcgatctgcgtttgcttgccgcaaatggggctcgttgcagcgggtgtcacggccgcgaaggcaataacgctattcaagcccaaattggtggttatgaccggcatctgcgctggtcgaaaaggcgattgtgacctcggggatatcatcggtgcgaatctgacatgggactatggcagcggaaagtttactgaagttgccggtgcggttgtgttcgagcccgcgccgtttcaagccgccgctaccgcacgagtcgggggtgtgttggcggaactttccaacgataacgagctattgcagaagctgtataaggaaagtccgggctatagacctgctaaagttccgaagtttcatgtggcgccgctcgcgtcaggcgcagccgtccaaaatcataaggagtttttctctggcgtagttacgcaacagcgcaagatgttgggggtcgacatggaagcgtttgccatagcctgggcgtgtcacgaggcattagagcctcaaccaagttggctagtaataaaatcggtcgtggattttgctgatggaacaaaagatagccaaatacaatcgtttggttcgtatatcagtgcatcactggcaatttacgcagtcgatagactgataaatcgttgatggggtgtcagttgccggtcagtcgtccggattcggtggcttcttccggttcaaggcggtcgccggtcaggagatcgtgccaccctaggcgggtgccccgctcatttcgatgggctggctttcctgttcgcgcgaggcattctcgtgcggatgatacataatctggaaacagggctcaaagctaggcgatcgtatccgctagccgctgcgcaacaccttgtagctaccggccggaggaagaagcgttgcgcagaggaacatcgagagcgagcatttgggggatagtccgcgtcatcttaagggaactcataaagccggatcattctaacttggaaggcaaggtgaagtccgtcggactgaggtctagtcgttgttcgaagttttcgaactcggcggggctaagaacaataccattgccccccaccaggccgcccgtctgcggaagtccctgcgcttgaacatctgtaaagctcgggatttggccgtcgggccaggcgtcgatgctatcgagtttgatctgttttggttccagaatgacgccgagcaatttcgggtcaagccggtagtctgacgtggcaaacatctcgcgggcatttgtggcatttgtctcaatgctctcgagcgagccactcacaacgccggtaggcagtaaatccaatgtttcgccgtccgaagtcttgaggttgcgtgcgatcgcgttgaacttcccgaccgcgacagccaatgccttaggatcttcgagatttatcgcctgcttctctactgttgttgtgaccatcttcggcaatgacgagcaagttctgccgccgaacggcgtcggcttgcactggagctcgttgacgaccttagtctccaacgtccagtcgggcccataggtggcgacagcccaatacatggcctttgccttccaccccggcactccgtttgcgcgcatgccgtagtagaaatttcgatgtgtgtcgtgggccgtgcgggatttggtctcgcagaagtagtcgtggatcaccgatgccttgagataagcgccctcaaagggaccccctataatcgaccaaaaagtctgcgggatcgacgctccatcaactctcgtccccgtgggcactggccactttaggccattagggtcatcgaagctgaagtcgctcgacagctcgaacagtggacgcggatcagcatcgataaactgtcccgcgggtccgctcgagaaggtgccgaaaaattcggctgcctgggcctcggcgacgccgaagcccagaataactgtggcccccaacaatcgcttagaaattttcgcgatttttcggatctctgccggccaagcgcttcccatgagaattaccctcctgtcaggccgatgtttcacaagtttgggagtagttgttgcaggtcgcttctgttgagtatctggatattgcgcagttgcagctcattgattgcatcgttcgcgttcttgatcgcgctttgcgccttgcccagacgtcgccttggtctgcgttcgtcgcgaggctcttcctcctcgtcctgcacggcgacgccaatggtgacggtgtgtatgtcttgtctccaatgggatgactctgcgtcaacagccacgatcttcaaatggttagcgggatccagttcggcactgggagtggccgagaagctgtttttagtcgtgaactgaatctcatcggcaagtttgttgacctttggctgtccactatcagtgctgccaagaatatggtcttcattcaggcgccaaaacgtatcgattatttcttgaagcccgatgtatccggttatgggataggcgtaatttttttcgcgcttgaactttccgttctcggaatagggctcgcacctcgggggatccgtgaatagcttgtagaaattatcctcgactctaaaacgccgctgatttcggcgcgttcgctcgtgggcaccggaaacacccaagttgaatattccactgctccaggtatcgttcagagtagcgccaagactgtttctgctgtgctgcgacatatcgaactcgaagtcatagacaatcgcagcatttgcgtagagatcgatcttctttcgtgttgcatttggaagtcggctgcgatcgaagttcgcgattgtgtttgggtcttcctctatctgggtgacaatttccggagatacgttgctgcgactgttttttaagtactcaagcagttcggacaggacggcatctcgcgcttcgcaccgaattctggtgacgatcgcataagtattcaatcgggtgacatcttccggaagtggcctgatagcgcagttcggcaacaaagccgctgctgctgtcaacgcgatcgcatgcctcatcagtgccccccgacaaagacccgctgaattggtcaacgctgagaatcggcggcgctagcttttgccgcataattccctcattagtcccctctaaattgtccgaaatgccggatgatggcaactttaaagtttagtgatcaacctatgattatgtttcgcgtgccggtcgccggctctgttgacaatgagttagtccaggcttgcatgtcgcgttttattggtgtctgatgggtgatcttaccagtcctgcgggtatcttgcccttccctgtaagcatggggttgtgtcagtgggcggaaggacctgggcgaccatcgccacgcttctgcagacgtcaaaaatgaacaacgtcgatccgctcgcttagctcacgcaaaggccccgatcttttcagtggcgaggagcgatctagttcagcgccaactctagcaaagcacgcctgggttcgtatcggctatgtgtcgtgaggtctcgaggcgtgggatgtgcagcgggtggccgtcgcagttggtgacgtcaaggaacttaacggatagattgtacctggttccacaaaacacgggatcgcgctgccgcggcttgaggcccagtggccaggcacgagttcaaagtgaaggaaccaacgattcccacccagaatttccgacagctcgcgcgatgagttttctgtaagcgtccggtgaggcagcttcgcgctgacggctcgcctttactttaccgaaacggctcgtgcgacaacttgtagtttgatcgcgtcaaaacagccaacaccggcgaatgcccagaacaacgaaacggctactggataaactccgcgaggtcgaagcgctccgaggtgacggtcgctcaccacctcgggggatgctgtcaagattcggaaagggtatggtggcctttctgcgggaatatgtccgtattctcgcgtatcatctctccgtggggccgtttccccgcctcagtaaaatcattgctgcagtcggtttagcggtgtctggtcccggagtcctctacaaggttatcgaggcgatcattgccggcgaagtccgcaatcgcggggcggtcattgcaaccgcaaaagaagaacctttcgaattctacaccatgacgctcattgttggctcgggggctgccttcgttaccgccttgggtgttgccgccttcctggtcctgatattgaagggccgcccatcgcgcagcgagtgatctattgccggcgcgaccgatgctatcgatcttgatgccgcatgttccacgggagcagttctccgatcctgttgatcggatggtcggcgctgcgggtgaggacgtcgcgaagataggcttcgggatcgagaccgttgagctttgcggattggatgagcgacaggatcgccgcggcacgctcgccgcccttatccgatccggcgaacaaccaattctttctgttatgcatatctatacataacagaaagtcatggctctttgccggctctgatcgaggtgccgatcgcgccgccttcatggcgacactgagctcaacaacgtcgatccgcaggcctggctcgccgacgtcctcgcccgcgtcgccgacacgccgatcactacgctggagcaattgctcccgtggaattggcagccgccgaagttcctgcgagatcaagctgcctaacctgcggccttggccggatggttacgtctcagcggctgcaatcgccgcaggatggcgccctgacgaggtcgcctcaacgttggttgaggttgccgaccacgacatgttcgcgctgatcgaaaaccgcgatctagcagccgatcttcccatcctccggttccgaccgcggtagcgtctgtcgccaagtgccggcaggcggcccgagccgtcactgatttatggtggcggcagcaacagagttggctggccttgatcgtcaaagaatgaaaccgcgttcgaggctcgttgctctcgccagtatcgttcggattgtcgcggtgctccaacggtcgcgccgactgtctgagggctggcaatccgttgcggcccggactcaatctgcggctttgaacgcgcggtatcgcgaacttcctgcggaatcggaataacgcgctgagacaggtgactaaggaaagtggtctcgcgtatcggaagccctcggctattctctcgccttgtcagtctgcgtacctcaacactcggagcgtcgtcgccggagagttggaggggttgcctgcgcaagaactcatccataaccagcctggcactggcactcaccggcgctcggggcagctggaccttcgtgtgaccataccggccgctgacactggcaggccgcgcgaaaaccaaacgctcgttttgcgatccgtcgggccggacgccgaaaccgggattgtcttccactcccacgacggtaagccacgtcggttcggcagggcttaggcccttgaacccgaaatagggcccgacggcgctgccagcgcgaacatacgcttgaagggcaagataactccggtgaaacttctttttctcgcgctcgccacgatgtacagaagacatggcttgatgaagcagcgatgcccctatcgaaaaaacgggaagcccgcggctgagtgcaacgtctatgcttttccggatttcggcttctgccaccccgtccgtcattgtgccgagtgcggcgtcgaggatcgcaccgtcggcgatctgagggaaccagttcatgaggttccgcacccaacctcggcgcgcggccagctttttgtttcgcaggaggaaatagcccgccgcaacggcagatataggatctccgactttgtcctggaggaaccgatccgcgatctgaagggtctcggcaagttgattggcctctgcaatcgatccatccgacaggtaggtgaggatgatttcgttgtccggaatgtcgcgcgctattgctatgtcgatggtgtcgctgtcgttgccagcgcttcgggtcaatgccacgcggaccctctgcccaggaggcagggccaccaaccgccatccaacgtgttcgccgccgacctgaagcagatgggggttgttggggacggggatcatgatttgctggacgccggtcctgtcgctcaaccgttcctccaccggtagcgggctactttgccatcgatcgtccaccagcgaccacagcgtcatccaaactttgccgatcgggggagccttggcagggtcgtcgccagacatctcgaccagatggtcgagtgactggaatggcgtgacccactccagccaatccgttggagccgtcttgccgatatcgaaagtcgcatctcctttatcaacttgccgattggcgatggtctgcatcgagcgaccgtcggggagcatagctacaacgtggaggcgatcggtttgatcgcgacggcgctcgtcaatcgttactttcgcggatcgctctggcgaagcaatgccagaggccaggaggtcacccttggacgagaacacgttgaagggaagcgttagtaggttagtatccttctgcgacccggaaacaataaccgttaaatccatccgacaatcccctcagtcgactttgatgaggcgacgaactgcagcgttcgtcagtagttttcgattataaatcttctccggaaaggacgtgggatcggtggaattcgttccataagtccattctccgtgctccctgacgaaccggaccgggccggttgcgagaggctttgtatccctgacgagagcggtgtcttccatgaaggcttgcgcgatggggcggaaaccttgcggtagcacgtccaattcaagcatcaccgacgggcgttttgacaagacgtggagaggcacggtccagttgccgtcaccctcggtttttccgattttttggcgatctgccatgccctcgggttggaggaactcgagaaattccgatattgcggcacgtaatcttgccacgtcgacggaatagccgttgccactcggatgctcgaccccgcaatgtcctcgaagcgctgacaaaagggcctgtgtaaagtgggcaactcctccgtcgggcgcgtaggccaagcggttcgctgttgtcgcccggacgattgcccagtcggtcgttgtcagcgcgcctctccgcgacccgccgataagcgccttcggatcctcaagctggtttatgatctcctcgctcaactccatgcaagcgtcgatgaaatagaagaggctcgccttggactttcggagcgtggcctgcaccgtcatcgtcaactgaaagacggcattccaaatgtcggcttcatcttcaccgaagtcatctgcgaccagatattgtgtctcgccgtcgctaatcccatggccgcagaaataaaagaccccccggctctggggattgagtttaaggcgttcgagccaggcgacataagcggtcttgaggtttgcgattgacgggcgcgtggtcttaaccttggtgccgaacggtgtgtcgtaggaaccatttggcgatgcgagcatcacgagtgagccgagaggggcatccgcgttagagaacgcttcgctcgggtctttcgcctgaccggctggcatcgcatcggatccggtcagaaaccagtcagcgacggcgaccacggagatcggcggcgacgtgagagacggcaggcttccatatcccgcagccgcaaggctcggatactcgccgcaaccgatcaagaggacatgcgtcgcggcgacggtcggatcggctttcactgccgtggattcgaaaacgatgctcatcgatatgtctattccgaccgccatgcgccccgaaaccgccatagcccgtgtcgtactggaaatccttgacgctcttgtaaataccctcggcactgaacgagaaaacgtcattggtgtcgaagacgttcagccactttccgacattcggattggcggcaatgcgatcattcttcggatcagtcggcatcccgggaggtagcggtcgactatagagcgccatctcatcgaacaaaccgacctgtgaaccgattgttgccaggtagtcgactttcagatccggagcgaaataggaaagaatatcgtaggtgatgaccccaccaaggctatgaccgacgatgataagcttgtcgtcgccctcctgccgggcggcatcagcgttacggaacgcctgtagaaccgccctaacaatcgggccgggcgccgccgcggtcccgcgatttttgaggtagacgaatacgtcgcccaggaatcgcgacgctttctgatgcgcggatttccgccccagcgccagcaaccctgctgtggttgcgtcggcaggtgccgaccccagcctggccaaggcctccttggtcgaggcgagccatccactcaaaccgaacgtttcgagctttttctcgtctgccggcagttccgcaatgcctctcagcagtgcatcgagaaattcctcattggatagcggctcggctttcaacgcccatgccggcgcgggatatttctcgatgtaacgctgtgacgcctgatacgccgctgcgatcttctcaatattctcgggagaattcgcggtcgcggctgcagcgtcccaaataagatcgacggcatccgcaaacgattggtcgcggctcaccttgccaagaataacggactttgcgccaaaggactgttgaacctcatgaagccagaggtcgatttcatttttctgcgctcccagcgccaaggtctcatagccgccacctggcagcgacacctggttccagaggaacttgacgccgtctccgccccaataaggaaagctgatgtgcaccttggccgggtcgagcccgagcggcgcggcaagcaacgtcttcaagaattcttttttgcgcgcgacgtcgttgtcaaagccagcatcttccttgcgattgttgaccccatggacgaacactattggcaaaacgacctccccaaccaattctgatgccttgaatcagttgtagccgaggccgcgttcgccctcaaagggaaaattttgtggttttttgcgtaagggggcagcttacctgtcaacttgcggagtcgccaaggcgctcatgaggtcatgggaaatcgcggtgacgacaaacaatgttggaacgcttgcgactgcgacagccacatcgattgcgccgagcatcttcaatatgtaaccgcgccttgcattgcactcgtcccattcgtacaccatcgagagatccttcactcgctgagcgaattgaagcaaaaacatgtgccaaaagtcgagtgcacaaatgacactcgccgggggatcaaacgatctcgagtgagaaatcgtctaggatttgtgcgacttcatcgcggaaatccagcaacggtccggaagacttcacgttgagcttggggagcgcccgatcgaaaagggcggtattggcttcgccatttaggcgggagtcgtagatgatcccgtccggtttctcgtcgtggagccagagtgctcgtgaccattgcttcccgagttcatgcgaagcggcacgggcagcatcggtcggtatgcgcatgcgcagcattccgtcggagcgcaggtccgcgagcagcagaggttggttgatttcgaccgacgcgcaagaaacctcctgaagttctgcaataccgataggaaaagagccttttgaaccgacggcgcgttcgcgcaagatcgcttcggcaaagcagacctttatgctgctgccaaaataaacaacgccgaaccggtcgggaggagacagggttgcgcgcttcgcaaaaactggacattgattccgctaaatcccggacagcaatttcattaaagtccggacagtttgatgcggttggtcctcggcagcctggttagcatcagggctgattgatttcgccgttttctgccccagtcaagaggggtgcgcttttttgctttcgcatgctctcgccccggagggtgatgcggtgagcattgtggacgatacggtcgagtatggcgtcggcgaccgtgctgtcggcaataaggtcgtgccagcttgccacgggaacctgagctgtgatcagggtggactttcgctgataacgctcctcgacgatttcgaagaggtgaaagcgctgctgatcggagagcgtatgggttccaaagtcatcgaggatgaggagctggacgcgggtgagcctgtcgatgaggcgggggaaggagccgtcgaggcgggcaagcgcgagctcctcgaacattcggggcacgcgcacatagagcacggagtgaccgagcctggccgcttgcctgccgaaggcacaggccagccatgacttgccggtgccggtgtggccggtgatgatcaggccctcgtgggcggtgagccattgcccctgggcgagcgccatggtgttgcgccggtcgagaccgcgggcggcggcgaagtcgatatcttcgatacaggcctgggcaaagcgtagcttggcggaggcgagccggttacggatgcgcttgtcggcgcgcagggtgacttcgcggtcgagcatcagtccgagccactcatcgcggctgagctcattggtgccggactgctcggtcaattcgcgccaggcggcggccatgcccgtcagcccgagggcctgcatctggtcgagggtggggttcgtcagcattcttgcttccttcactggtagtaggatcggccacggatattggtatgcgcaggcgtgggggccgcgtgttcagcctgcggtctttcccggtcgaggccggatttgaggatggaggcgacggaggaataggtgatggcattaatggtgagcgcccgctcacaggccgcctcgaggcgctgggatccatagcgcggcgccagcgacagaatgcccatggccgagcggtatccctgttccggatgcggcctgtcgcgcatcatgcgttcgaccaggatggcggcattggggccgatctgggtcgcacggccgatcagattggccggcgtggtgttggcatagcgctgatgcgccttgggcatatggtcgttgacggtgacgtggccggaacgctgggagcggcgaacatggctggcgacacgctggtggtcgtggaagatctcgaccacccggtgggtgagccgcacctggagggtgcatccgatcagccgatgcggcaccgagtagaaggtcttgtcgacctcgacatgatagtccggatggaccttcgccgacttccattccgcatattcgaacggtatcgccggcaagggcttcaaggctggccgctcgatctcctcgaacagctcgcggcggcttttgccgacatggcgcatcgtccggttgttcaggtcctcgagcaattcggcaatcgccgtgttgagggcggcaagcgagaagaaggtacggttcctgagccgggccagaatccagcgttccacgatcaataccgcgccttcgacccggcctttgtcgcgcggtttcctgctgcgggtcggcaggatcgtggtgtcgtaatgctccgccatggcggcgaacgtcgcagtcaatgtcggctcgaaccaaagggccttggccacccccgatttgaggttgtcgcacacgattgccttggtgaccccaccatagaaggtcagagcacgcacctgaccgtcgatccaatccggcaactgctggctaaagctggcatgggcgaaggtcaggttggaggcgcccagcaccgcgacaaagatttgggccggatggatgacaccggttgccggatcgatcaccggcaccgtcggcccggcatagtcggtctgcatcacggcgcccgccgcgtgccgattgcggaacgctacactggtgcgctgccgaaaggcggcaacctgctcgcagaaccaggtgaagccgtaaccatcaggatggctggcgcggtattcctgccatagaagcgtcagcgtcacgcctttgcgcttcagctcccgaaccaccagcgcccagtccggctcgctgagatcgcgcggcggtcgaccggctcggccgaacagccgccgctccagctttgcatcctcgtccgcgccgattggcaacggccacgaaagcccggcttcccgagatcgcagcaaataggtcgataccgagctcttgccgatcttcagccgctcggcaatctcgcgcaccgaaagaccctcttcatgggtcaggcgcagaatagtccggatatccctcactgtcgttcgtcttgcttgcttccgtctcggcatcggcccctctcaacgttgtcgtgagaggcctaaccaacaagacggcgcagccgcgaaccaacccgtcaaaccgccgccggaaactgtccgggatttagcggaatcgctgtccgggaattactgaaaactgtgtccggagattaccggaaatcctgtccggactttgccgaaacccgcagccggcaatgatcccatcaaggaagggatgagcgttgaggccactatctataatgcctataacgggcgccgtctggtcgaccgtattgaggggaggggcctcagcaaggaccatgtccatcgcttcggccgtgacaatgccaggcgttggcggaaggtccacagatgctacttcctcgatcgtcaacaaagtccggaccaacacgccgttcagccggccgcggagcattgtgatagaaggaccgacatactggtcgaaaacctcagccccacgcgcctcgatgtagcgaacgatgtcgtcgagcttgcgctcgcgaagacgtcgctcaccgagatcccatatctcaatatcaatgagataggcttgtccatcttggaaatcggccatttcaacaaggccgtcttcgcggaaacgaatcccaatgcggtcacgtggctcgaccgacccaatggtttcgatgccgcctatgaaattgttgtagggggcgttcttttggcccgcgggcgcgccgcgttggtaggcatccagccgcgttctgaactctgccatctcgtcgttggatgcgaacaacactagcgttcggtcggcgtcgctggataggaccgtaagtccgagttgctcccagtctgcttcctgcagtgcccccgtcatctggacgcggaggatcagcgctggatttacgaattccggcttgcgtctccggcgttgctcgtctcgggcagcgtttagctcgtctctgagctttgcactgtgccggggaccatctctgtcaggcggcggactacctccgccgtgcttgcgtcgctcaagctgttctggaagtctgacgagctcgagatggtcgtacttggccacggcggcctcagatcattggtgcaagacgggcttgtccggcacgccgccgcgcctcgtcctgaagtgcacggttgaaatcccgctcctggacttgcttgcgacgctctatgatcattgctttgatcgcctgagtacagacacgttcaatttcggcgaaggaatagccctcgagtgcagccgaatttcgggccgggtcgaacgcgacggggacattcttgaacttgagcttgaggaaacgaccgatcatcgcggcttcgggcctgtcaaaccaaaggacctcatcgaaacggcgccagatagccgcgtcgagagagcggtcgaggttcgtcgctgcgatcagaaagcccttcggctgcatgttgtcgataaagagcagcaggctgttaacgacgcgacgaagctcgttgtgctcgccactgtcgtctcgggtcctcgcgagggcatcaaactcgtcgaaaaacaggacgcacggctgcttccgtgcgaactcgaatgtctttcggatatttgtcgccgtctcaccaaggtaggaagaaatgaggcgatcaagcttcacccggaacagtgggagtcccagttcggcggcgaaaatttccgcgcaaagcgtcttgccgcagccaggcggtccgcagaaaagcattttcgagcggaccttgagaccgtgctggcggatctcatctgcccgacgaaattcttttaccaggccaagtagcaccctcacgttggcggcgctcagcacgatgtcgttgcgattatgttcgggttcaatacgctcgacgaaatctgcggcagcttcggggaatgggatgaggggggcgagagctttcggcgcagactgtgtccgctgaggaccagcctcaagcgttttccgcaatgtccgtgccaagacgcggttgttttttttctcttcctcgtcgatgatctgctcggcaacggcgcgaaaatcctcatcgcgcccgtagctagccagcaattttttcatcaactcgccgcgtgccatctgtcgtccgtctattcccttatgctcgaatcacagctcgacattatcctgtcaggatgatgctaccacatgatttagacaataaccttggtacggatttagttttgtcgccagcgaattcagcttgtgcgaagggattgtccacgtcgttcaacaaggtcgagggcagcttttcggtttttcgtaaccggctcgatttgatgagcgaaacgcccggagggggcgcagtcgctcccgcggctccttcgggccactatattgccgctcctgcggctgcttttttcccagcctttgtgtgacgcgaattcccgctgtcgcttggcagttaaacgtgagaatgcggctgtttcggccaggtttggcatttgaagatgagaatccgaccgaccggattctcaaattagctgcaactgcgaagacgtcatcgatcggcatgtatgggtcatgatctcgtcgatagcgttgctgaatcgcgccttgttcccacccatcatttggccacgcagcatttggagcatctcgggtccggcccgttcgacgatggccactccggccagcagagctggtcgtagatgcagcggtaggatcgggcctcgagagtgccttcgtctgggagcgggaaggcgattggccagctctttgagagcatgagcgacaactctttcacgtgcactgtggtaaatcgtggctacaaaggcggccgtgatgcgcacatcacggttcacaacagcaagggcagccgtcatcacttcggcgacatcaactactcatggcaatcccatagcgagtcaaacacgtcaaacggtcacgtcaaagtcgacgcagacgagtacaacatgttcctctcgctgaacgatttcatgagcagcgagaaaaaacgctatgacgcgaaacaggtcgccgacgtcctctggctcgaattcaccaatcaggcagggatcgaatatgactgaggtgaagcgtttccaatgtctaaactgcggtcatcgcttcgagattgacgtgttgacgccggatgagaaaaaggaggcaaggaggaaagacgagccggtctacccagtggcttgcccgcaatgccggcggaccgatgtaaggggtggctggggctaggcgccgttcaggcctcgccgataaactggattgggaggtatagctttggaacccccgaggaggaggtctcattgtcgaacgatgcggaacctgaaggaattggtgctatcgaccagctctacgacatcttagagatgctcgaagaagatataaaggatctagagggagcgaggcgagagcgcgtaaacgtcttcttgtaccagggcatctttgaggcgatcagttttttggacgaactcgggatggctggtcggataggtctatctgcgatggaactcgataaattccaacgcatgtctggcacaatcgacaacgcggtccttcgtcaaatgaccggacgcttgaagagtttattgcgggaggcaaactgcctctatgaccgataatgggggcgcaatgctgccgttcacagacttaagggacttaagagtggacgtcgccttcggggcggacaggatcctgctcccacgaaccctgcacggcttgttgctgtgatgttcaccttttgggccaggaagatcgcataatgtatcgactggcacttgcccagcttccccggggctggccgctctttttgaataacttaatgttagccgtttggcgatcagtaagctggtatggtgggcccggcggcaaccagtcggtcatgacgccgacggggcgctaaccaattaactacaggtcccaccaggacgtttcaagcacggaaaaaccgatggatcagtcgcgtagcgggatgctttgaagaagtgttttgaaccttgacgcaccagtgcggttcatcgataatcaaagtgaaccaaggaaggttagatcccatgaccgctgcgtttaccgtgcgtgtaaaagatgaaaccgcgagcaagctggaccagctcgctgagaagctggatcggtcccgctcttatatggctgcagaggccatcgaagctttcgttgagcaacaggaatggcagcttgccgagattgaagccgggttgaccgaggccgaccggggtgagttcgccagcgatgaagatgtggcgaaagtcgtcaggaagtacgtcaagtctgcccgccaatcatgagtcggaagcgtattcgttggacgctgcgggcgttgcggcgacttgatgagatcggcgcgtatatcgagaaagacgatccggatgcggccgctcgcgtcgtggcgcggattggcactgccgtggatgcgttagcggagtaccctgccagtgggcggcctggtcgtatcaagagcacgcgcgagctcgtgctggccgacattccctacatcattccctaccgcataagtcgagacgtcgagatcctcaccgtcatgcacgctcaccagcaatggccgcaggttctctagtcacgaccaacaaaacgcgtcggcacgatgagcgatgaatccgctcatcagcctgcccgtttatgtagaagcaatttctgcggcggcgagcgcagtggctgcctttttagtgatcgcttatgccgtgtaccaagtgtcggaaagcaagcgtgtgtgtcgacgccagcataacaatgtctttgatcggtcatgccttctccccgtttgagcctacgagccaccgcgatcttcgccgatccctgtactggcgctcggaaaaggcacaggtccggcgcgaactccccacggggcatcgatcacggccaatccgacggggcacgcgtcccccaggtgctcgaagcacggggcgatgggtcgttcccgactagactaatcggctcggttcgggaaggctacgccaattcgggccgtcgcccatggtgcagagaagttccgctacgcttcacgtggccacacactgcgagcatcccaagaaccgcatgagaagggtggggtcggcggttatggtgtggtcgcgacgctccggctggggcagggggcaagcgcatcggtatccgtgcggatatcggtacgcagccgatcgaagaggcaccatcctggtcttctcgagccgaaatccgggcgccatgcacgcctagggccatgacgggcacacgacgatcctgttcgccgcggcccgccacctcgccgagcacggcaagttcaacggcacgctgacgctgatcctccagccggccgaagaagtcggcgccggtgcccgcaagataatctagtaccggctgttcgagccgtttccggtagatgcagtctccggcctgcacaactggcctggcgtcccgtcaggacagttcggtttcgtcgaggggccggcgatggcgtcagcggaccaggcgctgatccgcatcgtcggacggggcgggcaaggtgcggcacctcatgaggcggtcgatccggtgcttgcgcctccttaatcaccgtcatggctgagccggaaggggcgccactgggatatcgcgtttcgcctcacctctaatcgccgtcggatgaaagttcgaaacggatacactcccggccggcggcgaccgtggccggtgccgttcgctcatccagcacgatgtcgagatggtcgtccttgcgctggctcatggcggtgtctctcatgctcgctccatccgtcgcatcggtcgacggccttgcgtcggatcggaccgaggcagcgcgcgcacgccgccgcctgccgcgcgttcaggcgggcgcatgctggcctccccccgcagcgtcgctgcggtagcggctggtcgaggtctggtaatagtgcgcgcggatggccgccatggcctcgatcaacggcccccacggcgcgggaaaccgttcttccgccataacccggtgcagcatgcgcgtatggccggccagttcgtcgttgaggaactccaccacaggcatagccggatagcgctccagcagcaggatcgccgcgttgtcggcctcgccggccgacctgtccttgtcgcgtccatgcagatcgttctgcaggcgccctatcgccgagatgagccgcaggacctggcgaaacgccggacgcgcgcgcaaggtcgccatgtccagcccccacagcaacgacaggcaacagaacacgtttgcgtaggcgatcgaatcgatgccgttgtgcaggtactcggcgtaggaccagcgttccgccgcccctgccgcctgcgcgtgtccggcgcgcagcgccgcgcagtagcaccgggtatcgtcgagaagctgagcatagtcgcgacgatcgtaggcgagggcggccagcgaagcgcgcagcacagcgcagccctcgaatccggggagcgcgcacggcacgccctgccccagcgcctgctccaccgcggcgagctgctccggcgcgatcaggtcaaggtcgttgcaatcgtcgagccagaacagcagcgccagttcgcgatagaatgccacgatcagcgtttcgtcctgcggatcgcgaccggtgcgggcgctggtgtcgcgcaggctcgggtggatgcgctgcaggatgtactggccgcccctgacggcttccgcggcatgctcgtcggcgaacccggtcagggaacgcccccactccagcacctgctgcagcccgcgttcggtcgggatcatggcgccgctcctgctccctcggccgggacgcgcggcccccaacgaagcgccagccacaacccggcgagttcggccacgcgcacgacccggatggggcaatacagttccttgccgatccacagcggcatctgcggcaatgcaggcgccgcatggcgggcgagcatccactccagcgcacgcgccaccgcctgcgcgatgcgccggcgccctgtcggctcttcgctcccgtccatcacgtgcaacgcgaacagcgcataggcggtttcctcgaatgtggacgcgcgaccggcgccccagccgccgtcgtcgcgctgcgcctgcagcagcgccgccagcgcgcgctcgtcgcgccactggggcttgccttgcgccagcgcagcgacggcatgcgcggtgggatacagccacgaaacgtgccatttttcattgtcccatagaccgtgagggttgcgattggcctcgacgtaggcgctggtgccagcggcaggctttcccaatagtcgcaacgcatgcagggcatggatgttggtcgacaccgaggcgttgcgctcgccggggaaggtgacgaacagctcgccgatttcgaaatggcgcaacgcatcgaccgccgggtcgcggcctgcaaggcgcaggacgcacaaggcaacggcggtgtcgtccgcatcagccgcgaagtgcaaggccgggcccagaccgcgcacgcccaggcgggcgtcgagctgcgcgacgatcacgcgcaccgcctcgtcgagcgcgggatgcgcgaacagcccggccaaatgtagagtgtacagcgaccagcatggctcgaacacattgatcggccagacgttgggaacgacaccttcgatgccgctgcgcgtcgcccgcgatgccgcctgcagatacgcgtcggcgcgcccgacctgcggcgtgctcccctgtgtcacggcgtgcgcacgccacgcagcggtggccgccggactgatgccgatgctgccgtcgtcatccgggcatgcggcggttggccacgtcccccaggcctcccaggagtgcagcaacggatggccgctcggcaacgtcgccaccgcccccagcttgaccaagcacgcttgccgcaacggcaacagcgcggggtggcgcggaaacgccacgccgcccaacaaggatgcggcctcgccgcacaactgcggcaggatcagctccgcgccgatcggcgcgtcttccggcaccgcatgcgcgtagggatcggcctggcgctcgaggaaccgggttgcagcctggactgcgtcggcagcgccgggaagaggatcggcacgctgcaatgccagcaacgccgcccacgtgggcgcatggcggaacagcgggaagtccgcgcttccccatccgccatcggcctgttgctgcgcgaggagccacgcgtatgcgtcctgccgaccggtgacgttgccgccaaactgcagagcccgcgccgtgtcgtagacggacggaccgacgctgccgccgtcgctcatctcgctcagcaggtggcgcaattcgaaaaggatctgttcggacagcgcattcacgggggatgttccttctgcagacggttgacgagaaccaggatcgggcagacggcgcgcacgtcgccgcaggcccgttgcggcccgccgcatgggcagcgccggacggccgctctgctccggcgcggcgatgagccccgatgcgggcgccggttctccgccgcatgggcttgcgcgcagcgtgccgcgtgcgccgtgaccgtgctgggcaaccgcggcgatcggcgccgcggactcggacacagtgctgcatgcatggctgccgccggccgatcgcagcggcacaggggcgactccatgcggacgggcgcgctcatgcggatggcgcgtgcttgaacaggtacgcactggcccgctgcagcatctgcgccaaccgttccgcacgcggccccagcggggcaatggcctccccggcctcacacaacagatccagcgcgaactggcgcgctgcctgcagccccatgatcgacgcgcaggtcggtttctgcgccgccgcgtccttgccgggggtcttgcccagcgtcgcggtatccgctgtcgcgtcgagaatgtcgtcgaccacctgcaacgccaggccgaaacaggcgctgtagtgatcgagcgcacagtacagcgtagcgtccgcggcatcctccgcgatggcgcatagggcgcccatgcgaacggacgcacgcactagcgctccgcacttcatccggtgcatcgctacgatcctgtccagctcgacgtgctttccgaccagcgacagatccatggcctgcccgcctgcggcaccctcggcagacaccgcctgcgccagttcgcgcacgagcgcgatacggttgtcgcccggcgcatccaggcttgccagggtcaggaaggcgtgtgcctgcagcgcatcgccgaccaggatcgcagtggcttcgccgaacttgacatgcacggtcggaaggccgcggcgaagcacgtcgtcgtccattgcgggcaggtcgtcgtggaccagggtacaagcgtgcatcatctcgatggcggcgccgacgtcgtcgagtatgtgcgccggcgtgtcggccagtgctccagcagccagacagagcagggcgcgggtgcgcttcccgccatgcaaggtggcgtagcgcatcgccgccataagctcggtctcaccgtggtcttcggcgcagagaagacgcgctagcgcctgttcgacccgctttgcgccgttctgcatccagatctccggcagcagcctgccggatgcgccgcgcgcccgcgcgcccaatccgccgagggcggaaacgctagttcggtcgtcgtgtagcgtggaaccggtctgcatgttgttcatgtccttgtacctgacaggagacggccacggcgagcgtcgagccgccgcggtgttgccgcgtcgcaccgaacgcgcgcgccgaatgcagcaatgccgcgcgtcgccggtgccgctgcctcgccacacggggcatgcgatgccagctcatgagaatccgatgcggattgtcatggacggatgtgcggtcgggtaatagcgccggcctttttcgacgccgctcagcaacagcggccgcaccccggccttgtgcatggtcagcgccaaggcgatggagaactgcaccagttccagccataccaggtgatagccgatgcaaacgtgtgggccggtaccgaactgcagcatgtccaccggccgaatcggctccgtacgttgcagccaccgcgccaggcggaactgatcaggcgcctcgtgcagcagcgccgaggtcgagaaatgcagcagcgggatgcacagatgggtgcccgccggaatgcgccgttggccgagttgcagttcctgcagcgcgcgacgcggcaggagcgtcgtcgccggatgcacgcgcagcgtctcgcggaacagcgcctcggcgaccggacactgctccaggtccgcgtgccgggtcggcaccgcgcctacgcgttgtgcctcctcgaccagggcatcccacagcataggctgccgcgccagttcgatcaccatccaggccatcgtcgaggcggtggtgtcgtgaccggcaagcagcagcaagcggatattggcgaccaggaggtcatcggagagcgcatcgtcgctgcggtcgaaggcactcaccatgtcgttgatcaacccggtgcgcgcggcatgcgcgcgtgcgtcgcggacgaactggcgcaactgcgcgtcgatccagtcgcgggcggcgcggccgcgccgcaagggcagtccaggcaggtcgaccgagggcgcgacgatcaactgcagtagttgccggtacttgcgatgccatcccggcaggtcctgcgcagggactcccatgagggtgaagatgagcttgagcatcaggtcgccggtttcgggcaggatggttacgtcgccgcggtcgcgccacgcctgcacccgcgcccggataacgggcgcgaacaggtcgccgatgccggcctgggtcagcccctcgggcaggaacgccgccttaatcgcatcgcgcgcctgccggtgcgcgccgccgtcctgggcgaccaacgttccgccaagcaattcgggcgcgatctcttcgatcagcgccgaggacacgtccttgtgccggagcagtgcgaacgcatgcggatccacgcaggtcatcaggtgtccggcagggccgaaatccagccagaagtggctgcccagcgtccgttccgcgcgccgcagcaggcgcggcaggtcgcagacgatggcgggaagatgcccgaccagggggaaagcgccgggcatgacggggatgtcgtaccgcagccggtgccgacggtttagggggttgagcagcacgttcatcagcagcgcgccgtttcggcggtgtcgcccgcagtccgcccggcgcagctgttgccaccgtcggcgtacgtcggcatatgcgccagcatgccgccgtcgatgcacacgacctggccggtgatgaacgaagcatcgtcggagagcaggaacgccaccagcgcggccacgtcctcggggtggccgacgcgcggcaggagctggtgccggctgagatgccgttgcatgcacttgtccagcttggccaggagacgctcggtcatgatgagacccggcgcaaccgcgttgcagcggatctgcgcatggccgtactgggtggcgagcgaggccgacagcatgttcatcgccgccttcgacacggcgtatgacgtctgcgcggtgtcaccgctgagcccctggcacgacgacatgttgacgatcgcgccaccgccgcgggcgatcatccgtgggatggcctgtcggcagcagagcagcgtgccgcgcagattggtcgccatggtctgatcccagaccgccaggtccaggtcgaggatcgcgcggtcgcgcggggtcagatgcatggcgctcgcgttgttcaccagcaggtcgaccccaccgaagtgccgctccgccgtctcgaacagcgctgccactgcctgcgcatcggcgatgtccatggccatggccagcgcattgcccgcttcggccgcgatctgcgcggtgcaggcgatggccgccgagccatcaaggtcggccaccaccactctgccgccctcgcgcgcgatggcgagggcacatgccttgccgatgccggcgccggcgccggtcaccacggccaccttgccttcaaaccgttccatcgtgtcctcctggaatgcgttggtctttcgccgcatgccgctcggcctccgccggagaacgcgcagggtcggcgctggcgcgctcgtcatcgccagcgtcgctttcgatgacccgaatggcggcgaccgggcactggctggccgcgagccgcacggcggcgtgcagcgcctgcggtaccgtcgccacgcacacttcggccacgccgtccggttcgcgctggcgaaaggtgcccggcagcgtcagcacgcactgcccagtggttccgcacagatcttggtcaatcacgacgcgcatctcagcccttgtacccttttcatgcggttctacggttgcgccctgcgatcagtcgccgaccgcctctcgccgtcgccatgctcaaaactggcaccaccttcgacccctctctggccgttcaaaaatgcgcttgttaaacggggggagtccccctgagcatgcagccgcaccggcagcgcgcggaacgtcctaaggaacgcggagggctcccgggtcggctgctcggccactgtcagcgtggggaagcgcgcctggattcgcggcaggctctcggccaactgcacccgggccagttgcgcaccgaggcagaagtggatgccgtggccgaagctaagcatgatcttcccgtcggtcgacatgccaggactggtgccgtagaaccgagcgggatcgaagcggtcgggatcggcgaaggcgtccgggtcgcgattgccggccgcgatcagcacgcgcacgtccgcgttcttcgggatcaccacgccgctcagttcgatgtcgctctgggcaatacgcggaatggagctgaacatggcgggggcgtcgcagcgcaggacctcttcgacgaatgcctccacccccgcggcgtctccctgcagccagtgccgctggtcgggatacgccagcatcgccaggacggcatggtcgatggtcgcagcagtggtggcgaagccgcccagcagcatgccccacagcatgctgatcaactccgcatccgatagcgtgtcggcatcgtcgtcgtgtgcgccgaccagcgtggccacaatgtcgtggcggggatcgatgcacttgcgctgtatcaggtcgccgaagtaggccttcatcctggcgctggccgcgtctgccgcggcgagctggggatcgctggcgtgcgggctcaggccttccagaatggcgccgatgccggcggcgaggccgaacatgtcgtcctgtggcatgccgaacagttcggcgaagaccagcatgggcaaggccagcgcgaattgccgatgcaggtccaccgcctccccgcgctccagcgcgggcgccatgccgtccaggcgcgctgcgacgaagcgcgcgatgctcggccgcaggttgtcgatctcgcgcatggtgaaatcgcgcgagatcagccggcgcagacgcgtatgcgtcggtggttccttcatcgctagcgtggacgccagcagattgagcgacaggctggtcgccgcacgcgggaaatagcgcgccagttcgcccggcgccggtccccgaaacgcgtcgcccgtggccttgagcgcccagcagatgtcggcgtggcggctcaacagaaagaggcccgacgccgcgcgatgcaccggatcgtgctcgcgcaaccagcgcatgaacggatacgggtcgtcgatgcaggctggcgacgccagttcggcaaaggcgtccgcgcatgctgtcgtggtttcttgcatgtccatcttggttacctgtcggctggctgatctgacaggcgcgccaggcgcgcctgcaaattgcggagaagatcgcgattcccggcggcgtccgcgcatcaccagagcaccgggaactcctcgaatccgccagtgatgatctccttgcgcaacttcagttcttcgggcgccacggccaggcgcagcgcgggaaagcgctggaagatcgaaccgaacaccaccttgagttccagcctggccagcgccatgcctatgcagtagtgcggcccgtaggaaaacgccaggtgcggctttgcgtcgcgtccgatgtcgaagatttcagggtcctcgaaatggcgtggatcgaacgatgtcgccggcaggccgaccagcaccttgctctccgcgggaatatgcacgcccgcgatggtcacgtcggtcctcggatagcgcatgatgccgtcccagcccgcgcccggcgggtacatgcgcaggatttcctccaccgccttgtccaccagggatggattgccgaccagacgttcgcgctgttgcggatggcgcaacatggccaggaggccgaattcgatctgcgcgacggtgctctcgtgtcctgccaccagcatgcccgccgcgaggccgatcgcctcttcctcggtcgcctcgccccggtcgaccgccgcgagcagatccgtcagcaggttgtcgcccggatcctggcgcttgtcccgcatcttgccgcgaatgtaggcgcgcagttcttcccaggccaggcgcgacgcgctgcgcgggccgctttcatgctggtgcgtcatcacctcgtcggacagcccggcaaaaaaggcgtgatcctcgtagagcacgcccatcagcgcgctgatgaccatggccggaagcggaaaggagaggtggcgccgcaggtcggcgggctggggctgggccgccagagtctcgaacaactgcgctgcgatcgcctcgacttgctgcgcgagcagcttcaccctgcggtcgctgaaggccggcgcaacgatcgtgcgtaaccgggcatgctcgcccccttcgtgcgagaccagccaccccggcgaaccgagaatcacacaatccggggtgaatgccgccggcggcattcccgcaggccggaacgccgcgtcggacagcaccgccttcgcctcgtcgtagcctgtcacccaccagccttcgtgcccccgcgggaagcgcacgttgtgaatcggaccgttggcgcgtagcgccaacatcgtgggcgagggctcgatgtgatcaacccgccacatcggcagcgtcggcaagggttgttcgggcatggtggcactccactctctaagcgatggaagggcatgccggcgtgtgccgccgtacaactagggcagcaagaaccgcgccaactgcgcagagagcgcctcaggtacactgctctgcagatcattcaatgtcttaactgagcgcggcacgcccgggccgaacatcaccatgtcgcggacgcgacaaacccgacagtagatcgacgcaaagtatgtgggtcgccttaccttggcgcagaagtcagggttcgtctgtcacgcatgatcggacctccagtaaagcgttcacgctatcgtttggtagctaatcatgaggatgcggctgtttcgccttagttcggcagggtaagttgcgaatgaagctcaaacgaaatttgccgacgacagggttttttgcttccagctcatcatcaccgaaaatcctccgctgacgtaactgatcttcctgcctttcgacgggttccacttgccgagactgacgaccgttgcggaattgtgcgtggagcccgtcgcgcagaaagaccgacggaaagtatgacaagggtggccaggcgaaaagtggagcgcgcaggccacatccgatacagggcgctgcgcttcaaatagtcacttgcgttcatgcgtcctctccttcgcgtcaattgcgacggagagaccctacgctatgccgattaggctaccgctatgctaccgaaaacgttggcaaaaacttgcttaatcggcatagttggacggtcggcataaacggccaaaatgaatgccgtcgatccgctcgacgggctctcgcagaccttgaatcgcattgctcaaggctggccagcatccgaaattgaagccctcatgccctgcacttcaagcctgacgttatcggctgaccgcttacgtcgaagggcaggtcatggcggaagaactcttcgccgcagagatactggaaatacgggttttccacccaacgggcgcacagctcctcgtccgacaggttgaacgtatgcttgaggatcgccagcccggccatcagccgcgttggcggtggtggcatgccggggtcggaatagaccgcgccgaagcgccgctccaaaagcggctagtcgatcgcctgcgccagccgcaccagttcgagcgtcatgttgatgatctgatccagacgggcatggaacaggtcctgctctcccgtatcgcgccgctcgcgtggtcttgacatcgccgctcctcgattcaccgccgctagtacgagtgaatcacgccgcgccgaagcagaaaaccgcaaaatcatattgcaagaaaagcggactcagcgagagcctttcggcaacactgcgtcacaggaaagcgaagaattaccgcagagaggcgtgggatagttcacggacgactcctcaagagtagttgcaaattacggctatccacgcgcggagaaatcgtctgctgtccgttctaatagcaaaacttcagacaaccggctttagaggtgcttgacgtttaacgatccgccccacttgtcatttaagtattcgcataccaatcgcctatgacagttatgggggtagcctctgaacaaagcaagcacgtgccctcaaacatctcgggcttgaggcgattctcaatttgtcgcgttgccattaagcgcatgaattgcccctcgtagactttccagtcgcctttgtctcgcttctaagccttcaaaatatcatcggtaggagccaaaaggggctgatgcacgtactgggcgccgcatatctctgttaggaagtatgccaggtcatcagccttcgcgaaccctgcgagctgaaaacggcaacatagccgaggtcctgcagcatcgcagcaaggaccgaacccaacaccggcccatcgccatcgtggggagttcccagggcatgggcggcagcaaaagccgcgccgcatcgctcgccaggctgtctttcgcaactccgcgcctgcgagacgattgcctgcgaggcggcgagcgcttcacgcaacttccggccggcaaagaccttcttattgaggagcggcgtgggccagcccaagaccagagggcagagggtctcgaagatccgctcggctaacaggcctgcccctgcggccatgcgctcctcgtcgctcgtcggcatgtccgtcgcattgaggacggcaattctggacgcaagcgattgcgaaaaactgcaaagcgaaaagacccgtcccgccagtgcgggcgcctcctcgcctgcggccgacgaacatgcgggcgagccgccgcggccggttcggcgaccgaacaagcgagcgcacgcgacactgtagcgtcgatccgtatcgtgcctgcaccgacgagatagctcatttcatcatgctcctcgttctaacggaatttgccgcgaaacaggtcgcggcgattgagaggagccgtaggggccgggggcggttcgatcgcggacggatcgaagaaggcccgtatggtctgctcggcggtttccagcgccgcctccgtcgtggcgaattcgaagaccggcgaaaacagtgaacagagatcgacacgcccgatcgtatcgagctcgccggcgttgaagcgaccgaacggggagcgggaaaaacacaaacagacatcttgtcacgcagatgcgaagcgtcccatagttcgcgcagcaaaagggggagacatgccgagcgtctttttttcatattcgcacgcagatgaggggctgagggatcagctcgaaaaacagctgtcgatgctcaaacgacagggcgtgattgagacctggcacgaccggcgcatcggcgccggcgaagatatccatcgtgcgattgacgatcacatcaatacggacgacatcatcctgctgctcgtcagcgccgacttcatcgcatcggattactgttacgacatcgaaatgcagcgtgcgatggagcgccaccacagcggcgaagccatcgtcattcccatcattcttcgggcatgcgactggcaccacgcgccgtttggaaagctgaatgcggttcctcgggacggcaaaccgatcacgcaatggccggatatcgacgaggcctttctgcaagtcgccaaggccgtgcgcgaagcagcagggcgggtaacccgaacggcctcggctccgcctgcacgggccgctgcggctgcgacgcctgcggcgtcgccggctcctcaatccctcggcccgcggtcgagcaatctgcggctcgcgaagagcttcacccaaagggacaaggaccagttcagacacgacacgttcgaatacattgcgcgtttcttcgagaactcccttaaggagcttggcgagcgaaacgccggtttcgagggcgttttccgacgggtcgacgcgaacaggttcttcgccaccatctaccgcgacggcaaggatgtgtcacggggcaccgcctatctgggtggggagacgtggggacgaggcatcaattacgttcacggtgagacgaccagcagcaatagctcgaatgagtccctgaacgtcgaggccgacgatcagacgctcttcttgacaagtatgggcatggcgtcgtttgggcgggatcgcgatcagaaactttcacaagaaggggccgccgaactgctatgggcgatccttatcgcccctcttcaggggacgcgctattaagggaaagcatatgctgtcaccgagtgaattcacgatcggcacgctggggagcgccgcgcctctcagccttattctgccacgaacgaaatacgaggcgaccatgctggtcggccatgtcgacaaagcgcctgcggctgtctttctttcaggagagtttgctttccattactttccgagtacggacaatgacagttggcgaggccttattgttccgggcgtccgcgtagaggtggacgagaccagtgtcttcgatcagggccaaaccatggctcccttgggcgcggctatccgaatcgatacgcgtcttgccatacgggcaaagagcgagcattcactcagcggatcatccgcccttacgattcacgataagctggtatcggccggagaccttcgcgcggggttcacaaggtggcagatcgtcatcggggaaggacagacgaagcgggtgctctggcaaagatccgacgaagacgaagccgctaaatcatccgcctgatttcggccgccaacggcgccaggtcgccgctgaagctccggatcatggcgtccagaaaccgcttcggctccagcttgctctcgtcgagctcgtatcccgcatagcgagtgagcatcgtcaggaagaccagttgggtgcggccgttgccttcgcgaaatggatgaatcgcgttgatctccgcgagaaaccagcttgcgcctttggcgaaggcctccttgctttccgtcctggcaaggtggtcgcgagcggcaagttcggcaaataggcgattggcttccctttcgatatattccggatagcaaaaccagttctcacccttgccggtgcggataatccgtgtttgcccggcccattcataaacgtcctgaaagaagtgtcggtgtaacgcgcgatagtgggcgaaatccagatcgccgtccggaagcgcttcccgcgcacgggaatcgaacatcaattgctcgaactcatccagctcattctgatccgggatattcgccctgttgcgcagcacatgggtgccgggatagcacagcggatcttcgacggcattgtaacggaccacccgtcagcccttcttaaaggccttgacgatctcgctacggtaggcgtcacccttgaggccgctcgcggtcagcttctccgaaagcgcctttgacgcggcattcatcttcaagccttcgacctgggcgaatttcgcggccttcttgccgccgatgggctgcgtcacgaacttgcctgtcacggccgagcgggctgttttcgtatcctttttcatgactcaccttaccatcgacgcggaacggttgcctacttctttatggcctgcccaggaacaggtcctgccaactgccttggccggtattccgcctctctcctgttctttccgacgcagaacacggcatgcgtgagggaaaggggaattgccgagaaatccgtctgtcaccggcggctcactcgatcttcgatcgaaggcttgttctcacccccatgggattttcgtctggagcctcggacgggtcacgccgtgttcccgccctggtcaatgcccgtacccccgctggccggattggcgccaaactgggctgatccctgccgcgctcaatggaccttccgccgcaagcggtctcccgagaacgccattgcccgcgccccgtggtgatcattcggcgaccggccgcagaggtggccggatcaacgaagagaaaaacaccaatggcgaataccaacacacctaagtcacccacgaatcttccatgtcgtcggcgagaaggacaaggcccgctgaaccaagatcggtcggctggcagcacggcgatagcgacggactcaacctcgttaatactacaccccactggtcgcaagccgtatggtcgcgcgcaggatcaaaacgcaggagcccgatgtatgagcacggccggtttcagcgggctggcggagtcaacgaacttcgccaatatcaacgccatcgggtctacttcaccgattttgaggattatcaaacaaaagtcgctaccgccgtttatgctttcggtcagccaatcgaggagctcgagctgcaatacatcgacggcgagttttcccgcctgttcgaggccgtccgcgtctctcaagccagcctgatcgcttggtttgacctgcttgaagcgctcggtggcgacgaagaccgccacctgatcgcccgccaccttgccggtttgggcaatgcggtcgacgagcttgccgaccgctgcgatgattacacgctgttcggtgggaccgcggcagactacgtggctgaaatcgtcgagaaatgctacgacgtttcgatgcttcggaatttcgtttgatcgagaacctgtgcccggttgcgagtgacctcgccacgctcggcaacgccgtagcggcattgtcgcgtttcacgacattcggcttgccgatcttctcggcccaccagcgcaaccagctggtagttttgacgctctggctatcgatgaccagccgtcgggcttgcctctttgccctccaactcccgggcttctatgacgagacgatggttgatgcgtggccaaagtccaagcaccctccaaggcccggatgctagcgctgaaaactgccttgtcgccgtctccgacgccggttcaatgggcggtggagacgatagcgggtatcgcgaccgccagcgccgcctccgaacgcacctggtgttttgcggtgcgatcccggcgcggtagctgtcgtcttcatgcctccgagtgaaggggcgtgagtgtgcacggaacgaagcatcacgatcgtggttcggagcttgcagttttgcaagtctacccgaccaggcggtgcctgcctgctcactcggaagcggagaaataccgatggcgcacggtacgaagcaaaagctgatgaaggcaagcgacatcccagcgttcgtgaatgaagtcatcgaggccggatgtgacatctgcgccgttggccacgaaaaatacgttattggagataccgacctgtcacggggcgcctatggaaaaatgagacagaggctgggtaggatcgaagaagcgtacggcgatcgtgatttcctcaaactcgaaatcgtcgcttacctgcgctcaattggcagatatgtcgacgtcggcgcagacggatctgaatagaaagcgcgccacatgctcccgcagatgtgcggcgaaatgccgggtagagcgttagtctaatggtccaattgccggagcatcttcgaagccgccgcccgtgaagccgccgcttcggttttctgatagcggtctgtttcgtcctgcccgatcaattccgccgaacggttaccgggcaatctcggccgcactgggcgcccgccgcgagatgatagtcgatgtgacgagcggccttgcgtgcatcatcgctcggctgcggaaatctcgctgcgagatttaaggagtgccattgcctgtgaagcgggcagggggccgccaaacagataaccctgcgcctcatcgaagccttcggcctttatcgtgtcgagctggtcctggcgctcgacgccttccactgtggtgataataccgagtgagcggccgatggcggccaccgccctgacaattgccagggattccttgctcttcggcagatcggcgatgaagctccgatcgaccttgattttatcgaagggaaaggttctgagataactcagcgatgagtagccggtcccaaaatcgtcgatggcgactatcacaccgagctgccggatctccttcagcgtctgaagattactgtcgcattcctcgagcaacaccgactcggtgatctcgagctgcaggcgcgaggcgtccagccccgtgtcttccaaactgttgcggaccgtcgaggcgagcctctggttcctgaattgcagcggtgaaagattgaccgccacactgacataggggggccacttgacggcctcggtacaagcctgacgaaggatccactcgccaagcgggccaatcaggccggtttcctcggcaaccgcaatgaactctgcaggagacacctgccctctctccggatgtggccaccgggccagcgcctcaaatgtcgtgatctggcctgtgcgaaggttggccagcggctggtagcggacttccagctcgccctttgcgagcgcgtgccgcagtgaaaccttcatccgctgtcttgcccgaagatcagcgtccattttgggctcgtactgaacgattgtgccaccgccgccggttttggcccgttcaagcgctatatcggcggtcttgataagctcgtctaacgactggtcactcttcgaagccgcggcaagtccgacaactacctgaagatcgacatgcgtccctgcgagttcatagggtgcttcgatcacatcgatgagctgctgcgccaataaacgagcctcagcattgctgttgatgccaacgcgcaagacgacaaattcgtcgccactgaggcgacagaggatgtcggattgcttgagaaaatttctgagccgctcagtcacatggcgcagcagcaggtcgccggtggctcgcccataagcgtcattgatcgccttgaagccatcgagatcaaggcagagaattgccagcctcgtgctcggcgcaatatggtccgacaggcgctcgaactcctcgcgcaggaactggcggtttggcaagcctgtcaacgcatcatgccgcgccatgtggtgaatttgcttctgcgccagcaatcgctcctgttcggcgttacggcgctcggtgatgtcgagcgcaatgccaacgaagccgagaaacgttccgtcgcttgcgaagcggggctgtcctatgtcgatgacccaggccgagcctccgccggcacgcttcagacgatattccatccggactggctcgcgaaggtcgaaggcctggtaaaatactctttcgacagcgttccggtcatcgggatggacggcattcaaccagcctttccccgccgcctgctcggcggtctgtccggttgtctcgagccagaggcgactgtggtagtcgtcggcgccgttttcgccggtcacccagatcatcaccggcgcgtcgtcggcgattgcccggaaacgggcttcgctctccttcagggcttcgaacatcttgcggcgatcatcgatgtcctcgactgtgccgtaccatcgaaggatgcttccgtcttcggctctgcgtgtggcggcacgactgcgataccaactgtagcctccctccgcagccgccaggcgaaactccacatcgagcggctctccggttgcaagcgatttcgcccactctcgctgaacctcgcccaggtcatcagggtgcatcgccttcgcccatcctgctccgagagcttcctttggggcatagcctgttttctcccagcgcggaccgatttccaggacctcgcccgatggatccgctgtccatggcacttgcggatgcagttccgtcagcgatcgatgatgctcgacgctcgcctgaagcgccgcttccgccgttcggcactcggtgacatccagggcgatcgccacaataaccttttcgcttgagctccctctcgtcaggatggcacgactcttccgagttacaaggcgccttacttctccgcccggtacggcaatcggctcctcgacggagacctcctccccggtagaaagcacgccaatgtccatgtcccgatagcgatcggcctctgccgtcggaagaatgtcgtaatccgtgtggccgatcaggtcgcatcgtgctctgccgacaagcatgcacgcggcatcattgaggaagagaaagcggaaatgctcgtccttgacgatgatgggctgtgggatcgcgttgaggattgcctcaaaatcggcgtcgaaagtcaactggttctcgaatgaagtccgttgcatcgtagggctcggtgttggagaggtaagttaatgatgtcggtcccggccgaggcgggccttaacaatcgttcagatgcgaaatggcgcatagacgccgcgtcaaacaccctagagtagcagcggttaacaataaataggccctgtcggctcgaagctgggattttggccaagttgaataacgttgtgggaacactgccgcggtgattgacgtgtgatttgtcggggaacgacatttcgctccgatttatggagtggagtggcgagtttgagcctttcgcatgaagatttggtcagccgctggagcctgagtttttccgatatagaatttgtaaccggcaagtcggtatcggcgcgccttgggctggcggcgcagctgaagtttttcatgacctacggccttttcgtacaggatcgcagcgcaatccctgccgatggtctctcatacctggccgagcagcttggatttgatgacgataccccgagcgaatacgattttggtggtcgtaccgcgcgccggcattgataagcgaagcgtcctcaaggccgggctttatcactgcgcccgctgatcctgtcggtgaatatcctcgagcatcccgccgctttgagagcgcgctgttgcatatcgaggttctgtcagcaatgaatattgaaaagcttctcggcggcttcgctaacgtcgccgccatccttacacctctggtcgcggttctcgcttatagtcgctttctttgggagcggcgtcagaagcgcttgcgcctggagagctatttgcgcgaacagaaattattcgagtgcactggccagcattcgttcctgcacttggtcgccactctcggaatgttcgaagccgatatcatggatgcgtcgtaccgcagcaaggttatcagtcgcaacgtcgccgtagatgttgcgggagagcctgtgaggatcgtccttgaatacgagccagacgacttggaaaaggaattacccaagcggcctggccgcggacagttctaaaaggaaaaacggttcgtgacgtcaatcagaccatctgttttcaaccaacgggtaacgcccgaaggcggaccatttctgcatttctacgatcatggcgaaacagcggaaacgcttgacgtttacttcagtgacgtgaatcccgagggggaggaacaccagagcagactgctcctccgagtgtgtccagaagctatagtgatgtggccgattaacgttgggcggggtagccaaaactacttagagcccaaatatgcctctctcaccgatatctggattcctcgtccggcctccggcccatatcgattgccgaagacgtctgaagacgtagacgaacttttagatcgccgcctcccgaatggttttgagacaaacgggcgactcggcttactcctgtacaaatatcgatcgatttgccgctccatcgcaggcattgacggtatcaccactctggttgttcatggccaaagcggagaaagggacgcaattatacgccccctagaatacgttctcggcaccaagcggtttcatgccctgaagcgcgaattgaccaggaccacgaatcgtttccgccgcgaggccagaaacgcgaggcaggaccgtatttacgaagctcttttgcattcagcggatcgcgaacgcttccctcggaaaaccagaagaaccaaaccggatgccatctccgagctcactcagggaggcgcgaccgacgggatatcgaagcgagatcgacgcaccgccgtccgactcgtacgacagagcgttaacactctggccaaagacgagccccatgtattgctggcgctatagagcaagattgagctcattacgctgaagggactgattgaccgatttaacgaaatgctcgcaaaggagttgcccgaatcgagatggcaagcgttcctttaagataatcccttcattctcagcatggcgttttccgcgccggcgatcatgatccaggataatgcttacgtcggcggtaagcgcttcaatggtagcaacggcaaatttgccgatttcctgatggcgaccgcttcgacaggcaatcgtaaccatccggcgaagtcatcaccggaggggtacaggcaatctggccctgatcgaaatcaagaggccccaaatcgacttgctgaccaagagcgcctatcgagggactgatgtctacggcccatcggccgagttgaacggagccatatatcaggttctggactagcgattccggcttcatcagaatctgcccatcttcaaggacgaaactgaacggaatgacattcatgtcattttgcagttaatcgtaagactcagatatagcgatatcaacgacttgacccggcacataaatcgagaataggcaattaaattgagaatcccacgggattttggtacttaatctgcgaaccgccgcgattactaaaatggcgattttggctgaagtccgcttccgcgtatcattcgtttgaatcgaggctcagcgccacgttgcgctccgaatgagcgatcgcactttattatctgtcatggtgaaatgctcacagatggcgcaactcagtcgaaacaaggcttcggatacgcactgaatgcaagcagaaccaaaagctgccgcatcggaagccggagaaatcctatgagtcatcgtgcaatgtctggtttagtatggtctcggatcttggtggccctcgacgtttcgatagatgcgctgtatcggcgggagtctcgctggacagcgaagcctttgaggcgttcggctaatgattcggttttgggatcgcgcctgctggtgctcaagtctgtctcgttgatgccaggttggtggcctgcaatctcgtcaattacactgctggagtgagagtgcttgtaaaaggtcgctgggaggaacctctccccatgaaaaaggcttatttgcgcatattccagcatggcgtcggggcatgtagtcactggagtagtcaccttcgtgggctatcgttccatggtggtgtagattgtcatgccaggcatcgaacgtcggtaattctcgatatgcggccagtgcaaattgtactccgaacatcacgcagtcagccgcagacttctgcgcgccaacctcaataaaagcccacttcgcctgcgttcccaactgccgaaacgaatccccccgcaatttgaaatacgaggcgacaaaggtgtaaaagttggctccctccatcacgataatggtgggtgctgctcccgcgcgtgtccgaacatcagcggcgacgtggtgctgctcgccgtccgccaaccgcacgacagcacgccaggcaccgtccgatgagcggtcattcagcgcgtcgaaaaatctagcaggcgagtccatgtgtctaaggtcaaggtccgggtagcgccggttgtagctggccgccaagagaggaagattcctgatgtccaacgataaaattttctcgtcaggctgtacgttggcagacaaatggcgtgctacctgccgaccgtattccatcagactggatgacatcccagcccgcctggcatgctcaagtgcttggccaagcaactcgactttctcgttgattcggggtgagagattacggctcgacggatttccaatctcggcccgccgagataattgcaacgaatgctggccttcaagatggggttgaggtggacttgatcgtgcggcctcaacgtaagcagcaaactaggtttcttggccgtgtccatagtcctgatggctctggcgccgtacgctcagccgggaaatgcaaccacccatatgcaagctcctgtgatacgtgtttacccgatctggctcttcaaaaaaattcatccgcgaaaacggattaaggagtcgcgatcgcatgcaaccgactaaccgcattcatgatcttccggcattaaacttgcacggcctcaccgtgatgcagtccgctaagatgcggctcaaaagttcgctgacgcgcctgctgcaacggcatggtgcagaatggcgaaatctggaccatccaaagggttgatatcatcaaataggcagtcccaattcgttggcgtggtgacgttcgcagatctgcgtatttggatcgctacgttctccaagttaactgaattagctttcgagaagctgacggctgaactggctgctgggccgtgggcttcgtgcagccgctggagcctgagtttttccgatatagaatttgtaaccggcaagccggtatcggcgcgccttgggctggcggcgcagctgaagtttttcatgacttacggctttctcgtacaggatcgcagcgcaatccctgccgatggtctctcatacctggccgagtagcttggatttgatgacgataccccgagcaacatcgccatcgcctcgatcgacgaaccggcggggcgggtctgcgatgttatcttccaaacgcgacactgtcgatccgcaatgcggacgtctggggtgatgcggggacggcatgcgcctccgattcgacgaagttcggcgcatgggaccgcaatctgatgacggaatggcatgcccgctacggaggccggggtgtgatgatctattggcatgtcgaacggcgggcaacctgcgtctattcgcagctcaagcgatgctcgtcctcggaggttgccgcgatgatcgacggcgtgctgcgccattgcaccgacatggaagtccagcgtcagtacgtcgatagccacagccaaagcgccgtcggcttcgccttttgccgacttctcggctttgagctcgccccacgcctgaaggcaatcgcccggcagaagctcgcgcttccggatgcaggcatgcggacgcggctaccgaacctcctgccgatcctttccagcgtgatcagctgggaagagatcgagcagcaatatgacgagatggtcaaatacaccgccgccatgcagaccagaacggcggacccggaggccatcctgcggcggtttgcccgcgccgaggtgatgcatcccacctacaaagcgttgagcgagctcggccgcgcggtcaagacgatattcctgtgccgctatcttcgccaggaatcgttccgtcgagaaatccacgaggggctgaatgtcgtcgagaactggaacagcgcgaatggctttgtgttcttcggcaagggcggcgagattgccaccaaccgggtcgaacaggaaatctccgccctggctttgcacctgctgcaagcttcactggtctacgtgaacacacgcatgcttcagaccatgctggcggaaccgaaatgggccggccggatggcaccggaagactatcgcggcctcacgcccctcatctatagtcacgtcaatccttatggccgtttcgatctcgacttgaatagtcggatcgactttgatcagcttgcggcataatttttggagacgataatggtcaagattgctgaagcatgcctgaatgttctctaccagcacgggttgtcgtcggcacagttccaattttggttcgagagagcaaagcatgatctcttggccgatggcatggcctgcgacgccattgttgctgaggttatgcagtccatggacgatcatccggacgcggcaaccttgttcgggttgctgctggatgaggcccgaatgggcatcgagaatgacagcccatatggaaaggccttcctggaaaatgcggagaaggcgatcagagctcgcattgccgccgacgctttcgaaccgcttcaccgcttgaaaatcgctggcttgtatcggcgtgccggtctgcccgtgccagacatactgatgcttgatccggagggggaaggtgccgccgatgagatcgcgatgccggatcttggtggcgtgcttgccgttttagcggcagaggttgaggctgaaggcggcggcgcgtatgagttcttcagtggcctggatgagatgacggcaggaatgccggagggggccaaagctgggtttattcatcatcttatgagcctcgataatccctttttggaacgctgcgcgctgtattggctggtgtctggtgcagcattgacccgggaggccgtggctgacggcctacgagaaaggctcatgcgcggggagctgcagcctgaaactgcatcctatttgccgattattcgtggctggttgccggcgagtgccgcccgggcggctatcgatgacatcggcaagctgtctcggcgacaaggtcttgcagatgcttccaatcaaaacagagcggagccgattgtcagcgacatcatggcgaccaccgctgacggtgttggagcacaaggcctgacgattgtcggaaaactacaagcccggacatttgtcgcgatgatcctgttaaagaccggatacggcatcaaggatgcctttgtcattcgttgccgttcaaagagcgaagcaaccaacatcgtctcttatgcccgccaggaagcaaacagcgtcaaaatagatcgaatgactgccgaactgctgctggaggcggctctggcggatgggatgaaaaacggccacccaccagcgccaggcttcattgacgtcatagaggcttgcagcctgagccaattgcggccccaggaaagggatctgcaggctttgctggaacacgtcgatccgcaaaaggaaatccagaatgcgacagcggcagagctgaatcggatgctccgcaatgcgtccgcactggatgcgctcgtcccgttcaccgacagctggtttgaagacacaggagaaacacgcggcatcatccagggatctcgctcagtgcggactgttgaaaaaaggatctgggcctttctcgaaggccggcgagacatttgggcgaggcgatttctgcaaaccgcgatcattctcaaatcggctaagaaggagcgaatgtcaaaagcactggcagccgcagccttcgccgtgatgcacaagcatcctctacaggacatcccgcttatgaaagatatcgctatgaccacactggacgcaggcggtggatctccgtggtgagtattttgcgtatacccatcgtgaacttcgccaatgaacagttcgaggctgtggattcctatttattttgggtcccgactgagatatcgaacaaatcgacgcgatggcacacgcaaattgaacagtttgcatggtataggacatggctcgtatcggatatgcccggacatttacaacagaccagaaccttgcggcgcaaatcgccgcgctcaggaacgccggctgcgaggtcatccgcgaggagcagaaaagcggtgcatcgctcgaaggtcggccgcaactgatgaccattctcgacttcatccatgccggcgaaacctttgtcatcacccgtatcgaccggctggccagatctctgcgcgatcttcaggtgatcgtcgaccggctcaaggccaagggcgcgcatctggttgccactgagcaacccgccgatacctccacagccgccgggaaggcgttcttcgacatgctcggcgtcttcgcggggttcgaaaccaacctgcggcgcgagcggcaggctgagggtattgccgctgccaggaaacgtggcatctacaaaggccgccccccgaagattgaccgcgcagaaatcctgcttcggctgcaacagggccaaggccccagcaagatcgctcgcgatctcggcatatcgcgcggcacggtctatcaggtgcgcaaaggtgttttcgaatgagcaaggccatccgcatcgcccgtttgacatccgccacctgcgagcaaatccaggcccgcatgcttgaggcttgcaggcagatcgcttcagatcacggcctggtcatcgaaagcgccgggtggcgcggcctggagcctggcttctcgttcgaacctgcattccgcatcagcattcccgcgccagatggcaagcccctcaatctggatagggagatgttcgccgtgttggccgaacagtacggtctggaggctgctgacttcgaacgcgagtttatcgctggcggcgaacgcttccggatcaccggcattgatccgcgccggccgaaataccctatatccgtcgagcgtattcccgatcacaggggcttcaagttcaccgctgacaacgttgccatgctgctcaaagctcaggccaaaccctgacgttcaccaatcgttcttcaacttggccaaaatcacagcttcgagccgacggggccaaatagcgggcgcatgtcgaaagaacgcatctcgaatcgaaaaagtgacgggaattgcgccagatcaaatgaaggttaaaagtacgaggttgatatgcgaagagctggcgcaaggaggaacgccatggcacatcatcgcaattggcggtcccggttcgatgcagttcttgttcgggcgctaaaaaatgctgttacgccgagcgatccggcgaaggcgacaccgcaagccaccgcgtcaggatttgatccacctccggcggggagtgacccgggagtcccctatcttttgctcatgcggatggaggtgcttcagctcgatcccacccgagtcaaagccttgatgccagccgactttcgcgtgctggctcacgtttgtgactattgtcaaggtgcgagcgggatcttctctacttcgcagctggcaaaccgactgtctatccgttgagagcgatgggtttacttcaaacagttcgccccgatcgacgcgtggcgaccgcctagggccagcaactggttagcagggcggtgcgccggccatgtgctcgcctccgccgaacgacctcgatagaagtgccagtatgaagtctcactggatcattgtgccgtcatggtgggccagaggtcttagagaccgcagagaggcgcgccaaatgatccgagcgacggcaatgtcggcaatccaccgcagcagatgcaagtgccacgctgcacctacaaggcacgcccgccggtcatgagacgaagccagcgacgaaggttatcaacaaaaatcgggcattgtttggtgctctctaacggtacgcacatcctgcgggcgcgcccttcatcgcctatttggaaaacttccggatccctcgaagaagcgacttgagttccggttcgtctactgcgccggctgcttcctctggcgagaaccaatgaagttcgcgttgccccctctccggatagtctcgtttgagctccgagacatttagcaagtgaacttggacgagagcgggcgctattcctgatcccttcagttttttgacataggtgtagtatccgagaggtttccttttcacctggccccgaactccggcttcttcccaggcttcttgtcgggcaatctcgtggggctttttcctgggcatactccagcctttgggaatgacccagcggcgactgtctcggctggtgatgagcagaacctgaacatcgttctctgctcccggattcggcctcacacaggcagcggcgtattgagccatgaccttacaccttcatcagcttggataaagcggaacggttcgtactgtcagccggcatcactcagcccgattccgattagcatcccgtcgaggattgggtgttcgaaggagacgatgtgagcgttgatgcgcataagatcgcgcagcatgtcgagatgcaacgaactcgtctgaaggctgtaggcgcgaccatcgcacaagcgttccagatgtggctcctaccattgtttctccctttctgcgaacctcgacgcggcgataaagaacgattgcggcgaggatcaccaacggcgacagccattcgactgccggtcgcgacaatccaggcagtgaccgcggtcccggtattggcgccgagcagcacaatttcgccatgcgcggcttgaccagttcacgctcgacgaaagatgcggccaccaaggccgttgccgttgatctctgcagcacgactgtcacgaccagccaaatccgccgttggtgccgttcgggaacccagtttggagcttcgctccaaagaggctagacacgcctttcacctgcgcaaggctgaatagcggcaagggctacagcgccgaaaaaaaccagtacgagaatcgtaagttccatgtctccctcacactgaacaaaaagcgctcagcgcatttttggactccagccagacgcagcatcccagtgggcgagcgtcgatccgcgtccgccgtcatggatcccgcacctccgaaaaggctgcgacgttcgatctcggggggatagcttggcagttcccgagaggatggtccgcgatgttcaagaaacgtgccaactgccaggaaggagctcggaagaacagttccgctacagttcaacggcttgcgctggagagtgcggcgtcgcgcgcctggccgaacattgtgtcgcgcacttcacaggaatagcgaacgggtcgccgtgttagcggcaacgcgcagatagtgcaaatccagccgccggcaagggccgctagcgccaccaagatgcaaatcgctccgatggattgcggcgactacgccccgcacgatacccgcctgtccggccggttgcatgccgatggcaaagggctcggcatgacgccttccgcgaaggaggcgttggcggggcgataggtgagggcggccggatgtactgcatagtaggcgagtatgccgtgcaccgaaggcctcgcccagaagcgcacggcagccgagcttgtaaatgccgagcttgtgggtctggcaggctgccacggacacggtcaccgacatgagcgatttgtggaaggtggcggatggccgcactcctgtaatagcctctgtcttagagtcatccggaggcgacaagcgtgtcgcagttgcgacatttcagtgcccgccgcgtctcgtcgggaaagattttagaaataggccaggcgggagtggtggttgattggccgttacacgtatttccaactgatggcccggccactgccttgcaaagtgcgtgacggcgcgactccttgatcgggcgccggcatcaggcgtcgggcgttgaaggcggccgggaagcgcggtcattgaggccagcttcgtccagcctgtctgtacttcaacgtgagccaaatctcagcttccagccgaaagcctccgtgcgacacattgccctctccgcgcgataaagcgtttcttcctgactacggttgatctcgatcaatatgccgccgctgcgcacagtctaccgttcgccttgcaacgattggttccgatccaacttatgctggttcaaggagaggtcagatgagcaggaatgatgcacggtatctgagatgtaccgcggcactgggtgcggctttcttcgcatgcggggcagccgcggcggagctgacatcaccgcctgttgccccggcgacagagggtgtagcggccgggctaagtccctggcagatccgcgtgcgcggtctgggcgtcctcactgaggacagtggctcaatcaacggcgtgcctggctcggacctttcctattcggactcgttgatcccggaactcgacatcagctacttcttcaccgacaatatcgccgctgaacttatccttggcacgacctatgccaacatcaaggaagttggcgcggtcggggttccggtcgggaaggcctggctgctgccaccgacgcttacgctgcagtaccatttcaccgacttcggcgccttcaagccctatctcggcgcggggatcaactactcgctgttctacaaccagagcgaaaaggcggggttccatgacctcgacgtcgacaatcatgtgggcgctgcgctgcaggtcggtttcgactacatggtcgacgagcattggggcgtgaacttcgatgtgaagaaaatcttcctcgaaaccgaatggaaggctgatcatgacgttctcggccccctgagcggcaaggcaaaaatcgatccgtggttgatcggcgcaggcgtgacctaccgtttctaatagaccattactgccggagagggagacgcaggcaccacccgtcgggcgcgtccccaattgtaaacggtctctatgcagaccctgaaggcgggtcacgtcgccctctgttccctggaaaatccagagtgacaggtgcaaaagatcgccgactccgtgcaatgtccgcggcgcttccgtcgcctccggatgtactctcgataaccggtggactttcgtcccgctgatgatccgttaaaagacaccgtttcgccggaaccgtacgtcagtcaacgatacccgactttgaaacgcattcatctacgcagtggatctttgctatccacacaaccgttttggcaatcttccgaacgccggtatagagagttgacttcaactggaggcaagggcgaatgtctattgcgagccgctgttagaggtggtctgattgtcgaactcactttcaggccatcggtctatgacgatccgccgaaccactgcgaatttgcccttttgtaggccaaggatgtgatgcgcgggaattccgatcatcgagatcgatccgaagcgcgcggccgcaggcggcgcaatcgcgcatgtcgctgctttgcgcgacgaacggctggcttgcctgcaaaagctcagaaaaaaaggccacgaagttcgtaagtctgcagtaaaggagtttcatttccatggttttttcattttccacgttcaatcggctcgtcaccttcaccgtcatggccgccatcgtcagcgtgcggcctttgacggcggaagacctgtcctcccagcagcagtggccgggaacccccttgtcacgagtggaagcccttgcggttcttcagactctaaacgcgaatctcctcagcaatgccagtgcgacgctcacgctcgatcgctggtgtgaagcgcatagacttgcaccacccggttcgaagatcgtagcaaaacatgtacagggacacgacaagccagctaacgttcatattcgtaaattgctgcacgtcgggcctaacgagccgatcgtctatcgccatgtccgcctagcatgcggtgatcgcatcctttcggaagcagacaactggtatgtacccgcaagattgacagcggagatgaacgaggtgctgaatacgactgatatctcgtttggtcgagccgttcgatccttgaacttcacccgaaccaacctaacggccagactgctttggtcccctcttccggaaggctgggacatgtcagccgaattaccagtgtcgagctcagggcccttgattccaccgccattccttctcgaacatcatgcggtgctaaagttgcaagatggcacgccttttagtgccgtggtcgaaagctatacgaacaatgtgctcgattttccggctccgctgctatatccgcaataaagcctagtggattggctggcgactcggcgttagcacggaatccgattgaagccggacgccattcggatcggacaccggacaggattcggattgtgccgagcagtttggagtgatgaggcctccgccaccggcgtcttaatcgttgagccgatcggaaggtgcgtgaatcagcgctcgcttgcaagtttcccacgcctgctcagcgaatagtcaagcgtgtccacgctgcgctcctgcccagtcctgacatttcgatctctgcctactgaacatcaatgaaaccacctttgcccccgctatcgacttcgcgaccgaacgctggagcgccgacggggtctttgaggcaagcggcagcgcgaatggcttcgaggggctcctcgatctggtgcggccgggcgcgtgccgtggtcctggtgggcctgccggtcgatgtagtgcgtttcgaattgccgggcgtgatcaccaggaaggtacgcatcgagaccgtattccgttaagccaaatcttcgacgccgtggatcgccgggcgcccccctgaagtcaccccgcatggcccagatgcggaacaattatgattgcggcgtgttcgtggtggacggcacgcgtgcgctggttagcatattggcgcaaggaccacgaccagcgcacgagccgctgcacctcgacaacctcgtcgccgatcggcaggcacttcaggaccgactgagggctcatcttggaccgatagaatttggggagcggcttgagcggctgtcctgcggccatggcgcccagcgcaatttcggcgggacgcaacagcccgcaccacatgaccctgttgcgggaggactcccaccgttgatcccgttttgagtatggcgcaaggaggcggtcggcccagatcggtgggccgccgcatgatgttagggagccttggccgcattctgacgacgatgcagctcttgccggcgcacttgttggtcagcgcgctcctgtcaagctgcgcgaggcggcgtagtcacgccgctgctggcattaaacgcttctgcgaaaacgaagacgttccttcatcaccgaacactcttctccacggcatcaacacctccggccaacaagtgttactccttgtgtccggtacgacacgtcgcctatgttcttgcagcatctccgcgtcgaagcctgacttatcggcgagcgtcggacgcggggggagaagaaatactatgttgctcacctacccgccaaggcagacctgcgcacgttagctgccacaatcaagtcctgacggagttgctaacaggcccatcagcagctcaaagaggaattcggacttgatcaacttcgaaccgcgatcctggcaatggcacggccctcatcgtcacgcattcatgattatagttgatttaccttccttcaacatcggcgtcttgcagcggaaaaaagaccactgagccgcggcatcccgatctcgcctccggaaagccatggcctattcttgtgcccgatccagacgtggaagacagcggctaaatcgacaacctgacgagtttggcgcgccctgcaaccgagtccgcaaagtgatttatcctagctgaatcgatgtagaggtctgaggtgtcttccaatactctcgctacggcttcagcggtggagtcgaccaagtttgtaattcggcggcgcaccaaaggtaagccaactccagcttcctttgcaaaagtctgccacccatcagcgtccatctcggcaagcgtgacccgtttcccgatcctcatggccattttcggtgaaaggtctggataggcgaccgtagaaagcagatcgtacagcggggccattttcggtccctgatcgtcgtagaggatcgagaaattcttgccgtgggcatcggcatttccgacaaccaggttgaagatcgcggcgtccagcagcttcaacacatctgtagcgggccgcgctgatactcgccgcaacagctcaaagcagtccttgaatgtcggcccgccctcgctggcgtatttcgtttcaggcggcacaccaagtgcttggcaaaagtcttcctggtggatgcggtgaaccacaccgtcggcatcgcgatagcgatcgtatcgctcgaccacaagaaaagggcgcccattcgcagacctcggttcgactggtgcaacgtcgaggccgatcgctgcagcgagtctcatcacgaatgcttcgttttcggttgtccctggaaagcgcgcgattggtggtttcagaatatgtgttgttgcttgtccggaaactggaagcgcgagctcgccgtcaatcaaaacaagcggcaccttggactgcgcgccggctagcgatagcctcaagccttcctggccggccaatagcggccgcgtcggaagtgcgtccagtatccgaacgattccggcctcatccagaggtgtcggctgctggtctggaagcggccctgcctctatgggctcctgatcttccggcaaaagctgaagtgcgccggcgacgtcgccgcccaagcgatcaaggagcgcaaagtcgttcgcaggtgaaacgcccaatgcctgcgctgtcacaagacgctggctttcctcgggcaacaggccgccgaaaaatggtcggcattcacgacgagaaaaaggttctgcgcgcttcgggagggaggcagacagcggaagcgtgttttcgtcgtcgagccaagcttcgctgtaggcaaagccgatatcaccgtgcctgtcctgggtgaattgcccgacaatgcgaccatcccaccagacgttgagaacccttaccgtcattttctacgttcaccaggagccagaatatcgatcgaacagccgagtgtttgcaaaacctgcaacacttttcctatctgagctgtcggtttgcccgcttcgagatcgacaatgaaccggaggccaacgccggcaacgcccgcaagctcatcctgccgcaagttttgctccttgcgcacgatgcggactagagcgccgatatcggctggagttttgatgcgcttcgccatttttttgttttcccgctcgggaaagtagcatcatatcggccgccctgtcgagtgaaatttcccggtcgggaaaatttatgcccgagaaggcgtatcgccaatgaaatttaccgctcgggattacgaaattgagtggcaattttggtggcaggctgagttttcgtcccgtcctcaaattctatgaagcgcagtataagcctgggcggcgtgcgggctcagattccgccgcgccgtttctgcctggactgcctcccttatctttaggccgctgaggggcggcgcctcacgtgcggcctcatcgacgacggtagcctttctcgcgcccgcaagtgcagctcaaaggcggcttgcgcctggccagcttgctgatcgtcggggagggcatgctgaacctgcatcgaagcgccagtttggttggcgaaaaattgtccatgctagtctcatctccgcagatcccggcggcacgctacgctggcaagctgccgagaagctgacgagcctcgccgcgcagtgtaaaaaagccgcgtgccaatcccatcgcggacacgaaaaaagtcctggacgcaagcgtgccgctgaatatgcgcatcaagcctgcggtccgcaacctgagcccgcgctgccgagctgcttgggaagacacgcactaatttcatgccggaggtctctgagcgtcgcgccgaggaggcgctgctcgtcgcgcacttcgttgcctgcgagggcaaccgcgtcatcgcctactgcgcactcgcttccggtgcggtaaagcagccgaagcggctggcggtttccggcgcaatatgcctgacccggttccgggtgccgtcctcggccgcctcgcagtcgaccctcctattagggtcgcggcatccgtagggcattggtgcacgacgcaggcctgcgcctgctccatgcttttgaaatcctcggcattcgcggtgtgctgttgcatgcgatttccagtgagcgcgagcgttctagaggcgatcggcttcctgccttcgccgtccgatcccacgatgctgacggccgggttgcatgatctcagcagtgcgctgaatccctgacgatctttaggccgccctcacaattcggatgtggttttgtaatcgtcattagaatgtggcgagcactgtagcggtctacccctttgccgaatcaacgctgtcgccgggcacgggcgaagcctgtagcaccgctgcggaagcgtaagcctcagtccccgcgttatactcggtaaaatgtggccgcgttgtcgtggaacagtgccgagcgttctgagaccgagaagcccacggtgatcttcttgaaggcattccaaatggcgtcgtaacttgagaacagcttatcgacggggaaattcgaggcgaacatcgccctgtcgaccccgaaggcggcaatcgcctcctcgacatatgggcggatgctctcgctggtccagttccagttccccataccgaggccagagatcttgcaggcgacgttgggcgcttgtgcgagtgtcttcatcgctttccgccagccctcaaaatgcgacggcccgtcaacctgcatgccggtatggttgaggatgatctgcacgtctgggaaatcacgggcgagttcaaggaattcctccatctgccagtagtagagctggaggtcgtaactcaggccgcgacgagccagctccttgaagccctgccgccattcgggcgtcctgctgacctcgggctcattcaggtaggtcttggcgccatcggtgtgaaagttcatcgactggcggataccgcggaagttcgcgtattgcatatgctcatcaagcaggtcgccgacatcgggcttgcggaagtccgcatagccgacaatgccgtgagggaagccatgcttgtccgcaacgccttggagccatttcgtttcgccggcggggttcgtggggtcaaatccgacatcgagatggaccgccttgacgaggttctggttcttcgcgtccgcgaggaaatcctcgatcaggtaggtcttgttgatagctgtataatcgccgaaggctgaaggcttaacaccgtcggaaagccaggggtagtagttggtctccaaatcccagaggtggaaatgggggtcgatgatggcgatgtcggacatggtatctcctcggggtcgcgggaaacggcaggcaccgccgttcccgcgagtctcctgtcagttgctcggggggaaaacgcgggcgatgaccgccttcgcttccgccgtatcgatcttgtcggcggtcacgagcggcatgacaagcgcaagatccttttcgaccggagcattggtcagagcgttgaatacctgcagcgtgccgtcgatgccctgtcccaccgcctcctggaagaagatcccctggatggcggtggctttcaacagtgcaatggtcgtcgggctgccgtctgcgaccgcgatgccgatctttccggtcaggccgcgggtttcaagcaccttcgccgctccggtcccggcctcatcatacataccgtagatcgccttgatgtccggatgggccgtcagcatgtcattggcctgcgtcaccgcctcattgacggtcagcccacgcgtctccagcatctggacaagttcgcagccgtcggctgcgaaggcctcctgagcgcccttgagatacttctgggcgttctcgcggtcctgcggaagggaaagcataccaaccttgttgccgccgcgctccttggcgagggcgcagacgaagctgccttgggctttgccagtttcgtagttgttggcggtgaccgaggacgtgtagtccgtctggccgggctgcgggccgatacccgcgaaagcgatcggtatgttctgggatttcagataggcgagcagaggcggggtgctggtcgagctcaccggaccgatgacgatcgcgtcgacgccctttgtcaccgcggtccgcgcattatccatctgcttggccggcgaattctcggaggtgaactcgacatagtccatacctagctcttgggccttctgcttcacgccgaagccgacccactgccaataggaaatgtcgagcgatggcgcgagataggcgaccgttttcctgtcctccgcatgcgagacgctcgacaacgctgccagcgctgcacccgctgccatggcgagccacccgttcagtttcttcctcatgccttcttcctcctcttgacgtccaggtctcccccgggacggattacacggcaccgcgccgcgatttgctgaagcgatcgatcaggaccgcgatcaggatggcgaggccggtgaccgatccctgccagaaactattgatgccgatgagattgacgccgttctggatgaccgtgatcatgagcgctccgagaaccgcgcccaccgccgttcccgtgccgccaagcaggcttgcgccgccgatcacaaccgcggcgatcgcctgcagcatgaggctcgaaccggccgtcgattccgcattgagaatgtaggaaatcgtcagcaatccggagaaggatgcgagaagtgacgaggcaacataagcgaagaactgcgtccgcttgacgggaattcccagaagacgtgccgctgccgcgctgctgcccacggcatagaaccagcgccccgcgaccatcttcttgagaaagatctcgatcacgacgagcaggacgatgcagaacaggatgtagttgggcacgccgggtatcaggctgccgctgttgagcagccagaaatccggatcgccgatcggcatcgagcgtccattggtgacgatgaaagcgagtgagccggccacggcaaaggtgatcagcgtgacgacgaaaggcgcgagaccggccaccgtgacgagaaagccgttgatcgaaccgaacacaagcccgaccccaagcccaatcagcgcggcgctgacgtcgagacctgaggccatagcctgtgctgtgaccatgccggtcagtgagaagaccgagccgacagaaaggtctatgccgccggtaatgacgacgagaagcacgccgagcgacatgatgatcagcggtgctccggcctgtgtaatattggcgaaattgccccagctcatcgcctgcggcacctgtgttccaaccgcgagaacgagaaggacaatggcccctgcaatcgccaattccgtacggtaggcggaaacgaggccttcccgagttcggattgcccctggcgtagccccggcctggtcaataatggtcttcgtcatgccgccattcctgtcaatgtcgcaagcttgtcttcgctgagttcgtcccgctcgatcacacccgatgagcgcccctctgtatcgaaagcgagcacctggtcgcagatctcaagcaattccgcgttttcggtcgaccaccagacgattgccgtccccgtagtcgccatgtcccggatcaactggtagatttcccgcttggtgccgatatcgacgccgcgggtgggttcttcgagcaccaggaggcgggaaggaacgttcagccagcgggcgagaagaagcttctgctgcgtgccgccgctcagcgtgttcggcaggtgccagagcgaaccggctttcactttgagcgcctgcatcaggtccagacactcgacctcttcccgcttggtggcaaacagggaaccgcgcgtcgcgcggcgcgatgcgagcacattgtcgatgatcggcagggaatggaggatgccgcggtgcgaccggtccccggttacgaagcctgctccgaggcgcgcggcctctcgcggcgaacggaaacggtcgggccatccggcgcgcgttaccgtccagcgcctttcgtgcgcggcgccaatgagcgcggcgatcagggtttcggggcccgcaggagcgccggcaacaccgagaatggtcccaggctggagcgttacggaaaaccctgtttccgcgatcgtcagcggttcatcggacagagacgccaccggtgccggccgagcggaatgggcaacggctgtggcttgcgcctgccccatatgctcgatgatggcgagatccgacagctctgccgtcggcacgttccccaccacggttcttccgtcccggataatcgagcaaacatgggcgatctggcggatttccttcatgcgatgcgagacaaagacgaccgagaggccatttccccgtgtcaattttctcagaaccccgaacagccgctccgtctcggccgcggtcagattggcggtcggctcgtccaggaggataagttcggcccccgacgacagcgctcgcgcaatctccaccatctgtccctcatggaggctgaggtcgccgacgagacggttcagcgcggtacccgcaaagtcccgatcaatcatcgaaagggcggcataggcctggctgccggccgtccttccatcgtaaacgcgcgagcccttgcggaaatgaggcagtgctatgctctcagcaaccgtcaggtggggaagaagcgcgagttcctggtggacgacggcaaccttgcggcgaccgtccgcttcggtgaggatgttgccggccatatcccggaagacgagttcgccaccatcctttgccgccgttcccgtgatgacgcggatgagcgtcgatttgccggcaccgttgccgccgaggagcgcgtgtatttcgccgcgcgctaccgaaaaatccacgcctttgagcacgactgtcgcaccatacgacttggtaagtgatcggaccgagacgatgtctttgctggcgtcggtcatagtcctgtcctcagtagagcgtgagcgccgggatgaagctcaccgcaagaaggagcgtcatcgccatggcaaagaagggccagagttcacgggtggtctcgccgagtggtgatttggcgatcgacgaggagatgaagagcgtcgtgccgatcgggggggtgtagagcccgattccaagattgatcaccatcatcagcccaagctggacccggtccagaccgatcgtgtcggcaaggggaacgaagatgggtccgagcagcaggatggcgggcggcatatcgagcggcatgccgacgatcagcatcaggatgttcatcattaggatgatgacgatcgggctcgagatgttggcggcgacccaatccgccatctgctgcggcgcctggtcgaaggtcaagacccaacccacggcggcactgcccatgatgaccagcatgaccacgccggtggccatgccggcctcgaccacgttgtcgcagaatcgcttccatgtcaggtcgcggtagtaaagaaggctgagtgcgagcgaatagacgaccgagagcaccgcgacttccgtgggcgtggccaggccaaaccgcaggaataggatgatcagcaccggcagcagcaccgcgggcaggctcttcagtgccagcgtggcgagctgccgcctgctggtctgcgagggctgcgaggcgtagccgcgcctcaccgaaacgaaccagcagacgaagacaaagctcgcggccatcaggatgcccggcaagatgcccgcgacgaagaggttggcgacactgacgccgcttaccagggagaagaggatcatgggaatcgacggcggtatcagaacgtcgatgaccgccgaggtcgcgttgttggccgcgcagagcgcgggcggaaagccgtgctttttctgccacgggataagaacggatccgagggcgctggcattcgccacggcggaaccggagacgccgccaaacacgacggaagaaacgacggtggtcgacaggggtccgccccgccagcgctgcatcgcatgcgatgccagctccagcagctgccggccgagctcaccgccaagcatcagcgtgccggccagcatgaagaacggcagcgcgagcatcggaaaggattgggtctggtcataaatctgctgcgccacaatcgaaagcggcagatagccgttgaacaggaccgcgacgccggcggcgataatcagggcgtaaccgaccggcactgccagcatcatcagtgcgcagaagacaatgatcatcacgatcgtcatagcgccacctcgccgctttcggtattcgtccggtggtcccaaccgaggcgcagcacgcgcagagcgacagcgagcgtgacgatcgcgaccagcacggatcctacggcaagggcgaaatacccgacgctgttgggcaattggaggaccgggctgtgttcgatcccggcgatctcgccaacaagataggcctggtagccgagcatcaggaaagctccggcgctgacgagattggcggcgacaaatgcagttgaacgtgcgccatcccggagtttgtcgtagatccactcgaccgccatatggccgccggaatgggccgccagcacgatgccgccgaggatgaaccagggaaagatcagcaccggtagctcctgagcgaatgaaaagcctccgccggccagcacgtagcgggcagcgacattcgcggtcatgaagaccatgagtgcgatgccgctgaatatgacgacctgccgcgcgaaccagacgatggcccgtgccgtcagctcaacgagatttgagaggcttttcatgggatgctcccgcgccgacaaggcctcagcctttggctgccgattcgatctgggcgacgaaattcccgaagggcttcttctgctctcgacaacagaagcagtcgccttggcgaagccttcgcggtccacctcggtgacctcgatcgcggaaatgcgcctgaaggctgccaacacttctgcgtccttgtcggcggaaagcttgcgctgcagttcgccggcttccttggccgccgccttcactgcctcgagatcgccgcctagacgggcttgtgcaatctgcgacatcaggaacggcgtcgattcccatttatggccggtgagactgatgtacttgtttacctcgtagagcttggagctatcgatattggcgagcgggttctcctgtccgtcgaccacgccctgctgcaaagccacgtagagctcgccgaaggcaatctgctccgtcgccgcaccgagagcctgaaaaatatccatggtcatcgggtcggcgggcgtgcggatcttcattccgctcacctcggcgggggctgcgaccttgcgcttcgaattggtgaggtggcgaatgccattatcccaccagtcgagcggcaccacgccgaccgcttcgaagcgcttgacgagttcggcgccaacgggcccaccgagaacctgcatcgccttcgccgtgttctcgaacaggaacggaagaccgagcgcggcaagctccggaacgagcgcggacgtcgctccctggctgttggctgtgacatcgagcgcgccggtgcgcaggctcgtcagcatcgcggcgtcgctgccgagtgtttccgcgccggccacattgatggtcacacgaccggctgtcttctcggctaccagttcggcaaacttcgcggccgcgacagttcgcggatttcccggtgcggcaccatggcctagggtcagtgtcgtgccggcccgtgcgggccgaaccatcgtgacgatcgcaggggccgcgagcacggccgatgacgcggccaggaagcggcgtctggttatctcgtacttcattgtctctcctccactttgaaactgttgcggccccgatgctcctccagcgcgggtgaccgttttcgtcactcgtcgagccactccttgatctgggccacgattttcgtggtcgatatgccgtacatgtcgtgcagggtcggcagggcgcccgcttctagaaaggcgtcgggcagtccgatctgccggaatgcggcgggacgcacagcggaccgcatcaaggtggcggcgaccgcttcgccgaggccaccgataacggtgtggttctcagccacgaccacaagccgtccctgcctggcgcactcagcgaggatcgttgcctcgtcaagcggcttgatcgtcggaacatgaagaacgccggcatcaatgccgttcttgcgaagttcctcggccgcttcgagcgcccgcatcgtcatcagaccggaggaaattatcagtgtgtccctgccatcccgcagcagcttggccttgcccagttcgaaccggtagccgtattcctcaagcacgagtggaacattgccgcgcagaagccgcatatagaccggaccctcgtgggcagcgatggccgggaccgcctgctcgatctcgctggcatcgcaaggatcgatgatggtgaggttcggcatgccgcggaacatggcaatgtcctcggtcgcctgatggctcgggccatagcctgtggtcagtcccggcagcgcgcagacgaccttgacgtcaagcatctcctcggcgatcgcgaggcagatgaagtcataggcgcggcgcgatgcgaagacggcataggtcgtcacccagggctgcagcccttcccgtgccatcccggcagccgacatcatcagcaactgctcggccatgcccatctggtagaagcgatcgggatgggccgcccggaagacatgcagatccgtgtatttggcgagatcggccgaaagaccgacgacacggtcgtccttttccgccaaggcggaaagcgcatgtccgaaaggcgccggacgtgtcggctggtcggcgccggcaatggaagcgatcatcgccgacgtggttaatcggggtctctccgcattgccgatcagatgggcggggcgttcgtatttcgagcgtctcatgccgtcactcccgcgtcgatgatccggatcgcctcggcccattcctgcggttcgacgcgcaggaagtggttgcgctcacgcgcctccaggaagggcacgcccttggccatcttcgtatcgcagatgatgattctgggctgcggatgccggtgctggcgcgcattgtcgaaagcgtcgacgagcgcatcgatgtcgttgccgtcgatgcgttggacgtaccagccgaaggcctcgaactttggaccgagaggctcgaagttgagcaccccgagcgacgggccgtccgcctgcatctgattgacgtcgacgatgccgatcaggttgtcgagcttgtaggaaccggccgacatggccgcttcccaggtagaaccctcgtcgagctcaccgtcggagaagaggttgtagacgaaggaccgcgaacctttgcgcttcagcgcgagcgacatgccgacggctatgccgaggccgtgacccagcgatcctccggtaatctccatgcccggcgtgtaggccgccatgccggacatcggcaggcggctgtcatcggcgccataggtttccagttcatcttcgggaatgatcttcgcctcgatcaaggccgcatagagtgcgatggcataatggccgatcgacaataggaaacggtcgcgaccttcccactccggatcgtccggccggtaggtcgtcgcatggaaataggcgaccgcgagaacgtctgcgatgccgagcgcctgtgcgatatagccctggccctgaacttcgcccatgcggagcgcatgccggcgaatgcggcgcgcacgctcgggcagactgatgttgtgaccgatctgagccatgccgtccttcctttcaggcttcctcgtggatcaatggatcagcatgccgccattgacgtcgatgacggcgcccgtgacgtaggcggagagatcggatgcgaggaagagatagatgttggccacgtcgcgcgcgtcgcccaaacgactgagcggaatgcccttgacgatgtctgcgcgcatctcggcggacagcttgtcgccggtgatgtcggtctgaatgagccccggtgtcacgcaattgacgcgaatgctgtcggggccgaactccctggccatggccttggcaaggccgagcacgccggccttggccgccgaataatgggggccgccgaagattccgccgccgcgctgcgctgaaaccgacgacatgcaggcgatcgatccaccgccattctgccgcatgtttggtatgaaaacctgactgagattgagcacgcccgtcatgttgacggcgacgatgcgctgccagtcggcgtcagagatatcgagggtcttcaccggctgggtgatgccggcattgttgatgaggatgttggcgacgccaaacgcgctcaagacctcatccgaggcggacgtgcaggaggcacgatcggcaacgtcgcaacgcagcccgatatgcgcaccgtgttcgaccggcggcaggtcgcccgctgcagcctttgcctcatcggcgttgatgtcaagaatggcgacccgcgcgccgtgcgatgcaaaaagctccgccgttgcccggccaatgccacgcttgctcgccgcgccagagatgacggcggtctttcccttcaaaagcatcttttctttcctcccgacaccgactatgcggcgcctggtgtctccttccaggcctctgcctgtcctcgtggaagagttgtggcgtagcgcgcaccgtccttcaaacgccaactttacatctgtgggtgaatctgattcactaatcccatgctgcagacgacgtcactctccgctatgcgcatttttgaagctgccgcgcgactcggttcgttccgggcagccgcggaggagttgaacctctcgccgagtgccgtcagtcatgcgattatgcggctggaacgggatctgggggtggcgttgttcgaacggacgacgcgcagcgtttcgctgactgtcgcggggcagacactactcaatcatgcgtccaatgccttcgaagaattgcggcgcggtgttgaacaaatttcatccaacaaggcgcaattgctgcgactccactgcgcgccgagcttcgcggcacaggtgctgtcgccccgtctgccgcagtttttgaaagagaatcccggcatagaggtccgggtggcggccagcaccaactacgcccgcttcgtcgatgggctcttcgatgccgatatcgtctacggcgagccactcaatcgtgaagacctgatcgtcatcccgctttctgaagaaatcgtcttgccgctttgcgcgccggatctggcgcaccaaatcaagtccccgcgcgacctgtttcaccaaccgctgatccgaagcgatctcaagcgcatccagtggatcgactggttcgaagccaatgaccttggaccaccaccatcaccatcgatgagttttgaccggagcttccttgccgtcgatgctgcggtcaacgggctcggaattgcgctcgagtccgatgtgttggccaggcgcgagctggaaagcggcaagttggtccgtcctcttcatcggatctgtcgcgacaaccgctatatcggccactatctcgcctatccaaaatccggcagccagcggcgactcgcccgcgcctttgccgattggctgacgcgcgaatgccagccggccagcactggctcagagtagacattccgccaggcttctcggccgcgacgtctcactcgtttccgagtgaagcggacgagaaatctttcaaggccggtcgctcaaccgtatcactgaaggggccgcgtacccgaggcgtgattgggactaataaccgtcattgccagataggaagcatgtgagcaggtcgatccggggaaactcgactgatcaaagaacgggtttcgctcattcccagattcgaaaccacgccggcggcaatggcagggaccagggtattaagggttgatttttggcgggctgcatggaggtacatcggtggggcgagaagaaaggcgaaacttcgcctccttcgtcggttctcgccactgggttcattttgctcagatttgcccgacatggcctaaggctttacgcactcacttattatccatgagtttttgaaacatgtagatgtattcgagggcgtagcggcgggcgtgttcctgcaggttggcggcggcggcgtgaccgccctcgatattttcataatagtagaagggcaggcccatgtcttcgaacagcgcggccatcttgcgcgcgtgcactgggccgacgcggtcatcctttgtcgaagtttcaaagaagggttccggatacgctacgcccgccttgacgttgtgataaggcgagatcgagcgcaggaaggcgccttcaaccggatcgtcgggactgccatattcggcttgccaggaggctcctgccgacatgcgggtgaaattgaccatgtcgagaagcggcacctggatcacgactgcgttccacaggtcggggcgctggatcatttgcacgcccatgagcaggccgccgttcgaaccccccatgatcccgagatgcggtgtcgaggtgaccttcttggcgatcaggtcctgcgcaacggcctggaagtcgtcatagacgcgctgacgatttgtcttcaaaccggcgtcgtgccatttcgggccgaattcgccgccgccgcggatattcgcgagcgcgtaggcaccacccttttccagccacagtttgccgagcaccgccgaatagctgggctgcattggaatttggaaaccgccataggcatagaggatggtcgggttcgtgccgtccagcttgacgtccttgcgcgctacgaggaagtatggaaccttcgttccatccttcgaggtcgcccagaactgctgtgcttgcaggcctccggcatcgaagcgtgctggggtcgaagtgatcttctcgacttggccggttgcagcatcggcgcaaaacagagttgagggttcgaggaacccttctgagaagacgaacaactgatcgctctcatcgtcgctagacgtcagggacagcgtcgaattttccggcagagccagcttgaaagacgaccagccgcccttgccgaaatcgaagctgcgcacctcgctggtgacattcgataggatcgacagcacgagacgatttttggtctgggtagtgcctgcgacagattgatgctcgtttggcatgaacagcacaagcggttcaacgcgcgctggatcggcgagcgccgccttgagatcgaaagcgataatcgcaccattgtggaagacggtgcctttggccgaggtccagtccgacttcaaccaatagattgcctggcccttgtagtagccgctaaagacggccgtggtcggtaggggcaggaccaccttgcgcgtatcggggtggccgtttgggtaaaaggctagttcggtattgaagaagtcgaggccgcgatacgaggtgtccataacatacttgccatcgatgtcgcgtagcacgccgcgctcagccgagacgtccttcttttggccgcggaaaatctcgaccgcctgatccaagctctggccgcgctttaccaccttggtgacgtaggcatagccggaagaggtcacttcacccggcgtccattcccgggtcacgtagatggtgttctcgtccacccaggtcacggactgcttgccttcgggtaggacgaagccttccttaacgaattcacccttggcaatgtcgaattcgcggaccacatccgcatccttgccgccatcggacaggcggatgaggcagagattgctcgtgggcggcaggcagtccccgccttcgaatacccaggtcttgccctcggccttggatagcgcatcgacgtcgagaattgtgcgccattgcgggttgccggacctgtaggactcccaggtcgtgcgccgccataggccctgcacgtgcgtgccgtcctgccagaagttgtcgatcatcccgtcgcgcgcgaagctgggcgaagcaatgcggtcggtcgcctgtaggatcgtcagagcgtcggcctggtactcgctgtaacgcggatctttcgacagcttatcgacggtcgaaaggttatgcgcctcgacccaggtcatcgccttgtcgccgtcgatctcgttcagataggcgcgaggatcggaggcgtccttggaagctttgttggggttggaatcaatcgccgtggcgacggtggtcatctggggctgggcgggagccgtcatggtgaccatagtcatcgccatcatcaagctgttcagaaatgtagtgagcatggtttgcctcttcgaaagcctcgataaacgtattggaagcgtttaaaatcaatcgcttcgcacccttctcagcaaatgctgtgccagtctgtgtgggcaagagctgtgccagcccggttttttcggggtcattgggaggccgttgtaggagaagtggcactgtgtgtcgcaaccgcgaaacggcgttggacgacgtcgggcgcggtcggatccggcacttcagggagttcgcgctatagggttgactcgggattgtcgacacccagccttgctttgtggaagaaccgcgcgtctgcgtatgaagagccgcgccgtcagcggcaatttggtcaacaagctcgggggatttttccgaaaacctggtaggccggtcaattcgtcatcccggactgtccacccaagggcgcactccaataagggtcaagttcagtgctgattgacacctccgccagaccgccgtcgctcatcaggccgtcggggacccctcaggagcttccggatatcggacctatcattggcgagaattggcgccacggctccgaaccagcctagaatgtcgtgatcgacgtactggaagatatcaatctactgccaaaccagttcggtccaaggcaagcttccaccttaccttgaccgtgcactagagagcgagcgcctcatgccggaagccgggcgcccgacatatatcaacatccgcggcgtgccttatagggccgagttgctggaagagaacggtcgctcacgggttcgtatttatcctgtgactggctgaggaatgcgcttgagctgcaatctcggttgtaagcggagcggcgcaccgcgggcaagccttttaccgccccagccactgtcataggcctgctcgtaccaagggcgctcatgggaactgccctgcgcaatgatatacgagcctttggttagatcgaaaacggcgaacggaagttcaacttgtacattcgatccaggagttcgctgctccccagtggaagagtgacctttcgccgtggggcagcaaccttatgcgttgacatacacgtatcttgcgcgaagcccgcgcccgataggatcacgcggttgcggacggtttcctgtatagcatgccgtcgcaccatacgtgttcaacgcggccccactcgcaggctgcggctgcacttgggaagaagccacgcccatggtaattggcacttgtgttgcaaagcaacggaatgcccgtgagcttttcatattcgacaagtacctcggcgaccttatgctgagagttcctggaaatggtttgcagccgcgcagatccgtcaagatgtacaactgcaggaactttgtcctgccacggcatcttcgtctggtgatcgaacaacatgtatggatcgggcgttcctggactaaatatatccggtgcacggtcctccagacatattggcgcaactggccggaagtgttcgcggaatttgatttcgttaagatgatctttcatttccggcgaggtcgcagccgccagaatgcttcttcctcccagtgcccgtggtccaagctcgctgcgcccggaaaggaaaaccacgggtttgttgctggcgaggatggcggccacttccgagatgctgcacgggctagcatgccacccagctggtactttgcctgcttgcaggctcgggccgctgtagactgaccagtctaatggcacgaacccttgctgggccactatttcacagcaggctgcaccaatcgcagagccgctgtcattaggaaagggcggtacccaaaccgaatcgaacaggcctgtctcgcgcagcgcactgttccatttgatattgagtccacagccgccagctatgcacagattgcgtgctcccggcaggggatggtgctgcaaggcgttcgccatttcgtcaacgaggagacgttcgaggaaaaaatgagacgatgcaagcacgtcttcgggcgcctctgcccccaattggagcgcgctggcagcgaaaaaatcgtgcacggccgcaagtgaggattccgagttgttgatgttcgcacggaaggcgcaggcaagcgcagtatcgccggcaaagtgttcttgatagagcttttggaacacagcaacgatgcgttcgtgaactgatcccagtgcgataaaggccatcagcttgccggcaacgccgaggtcccagcccccgcggctcgtctgcttataggggccgaagtagtggcccgcggcagcgtaggcctggcctgttaccgggaacaacgatttgacgaagctggctcgcttgccttccacatggtagagccgcggaaatatgcagccgtcccacaccaggcaaagcgcagggtctccggatttggcaaaggggctggtgcagtatgcagaggcgacatggctcgtaacatgcggatagcttctgtagctaaaaacccgatcaccaagtgtgaggccggagccgccgatccaatcgagaagtccctcggcgtggcgttcaacgtaaggcgcgcctctgaggataacaggagtctccccactgaggaccttgaactgcgactcggcctcaccgtcccagccgtcgatgacaaactgatcaacgtctcgtgcattgaccccgttttccgccagagccgccacaacagcatcgagattgttgatttcttgatagcgcgaattgttattccgcttctcctgctcagtacagaagacgagccttccatcttcgacaacggcgatagccccgtcatgggttaacttgatgccacagacgcgcatagtgtctctatccaaatcaggtagtcgatttctgaaaacgggaaagcaagcagtcttcattgaccgatgcgccgcggcaataaagccgctccacctcgatcaacgtttcgttcaacatcgcgatgacggtctcggcaccggccacatgcccccagcgccggcaattagcatcgattgcggatccaaaaaccatgtgcccacttggcgccagcatgctcaccaggttgtgaacggcggtgcgtatcgcggctacatcctcgagataataaagaacttcggccacgacgatcagatcgaatagctgctgagtcgagaactgtcgaacgtcagcgactatccagttgatgtgagacgattccttcatccgttgcctcgttcgagcaatcgctcgcggcaccacatcaatcacagtcagccgcttgcaataaggcgccagtttttccgtgaatgcgccggccgcgcacccgacttcgagtgcgttggtgataggaccttgggaaagcgacaaccgaagcatctgcgaatgtcgctcctgctcgaacgcattggcgtcgagccgccatgggtcctccgccgccagctcacggtgcaataaatgatagttgttgacctgcgtcaaattcgcctccgagacgccgtgcacggatctgcaaagactcttgcacatgggtgggcagagcgaggcgcgaatccggaggcgtggaatgcacgcgaattcccgaaaaagcggtcgccggcaacgatggctccgtcaatactgctacttgtggccccttgagttcgctcgaaagtcatacttttctgatgcagcatcaagcaaaattcgtaaaatcgatttttgtgatgccaaacatccaggttatggaagtttcgccagttccggtcactccaagggcgggcgtgttggggctgctcggcttgatcgcattcgtctggagtgaagagttggagtagtcgcccgatcgttgagaggctctcgatggatcgttcagcggcttttctcaacaaggctttgagctttgagagtgtgtattctcgatcgggtgaaatcgggccatacggcgggagctatccaagggaggcatccatgtcgaaatcacaattgggtggatgtgatggagacgtgttccaggcgcttgtggcagatgcctttgggattctcagacggcccgatcgatcctgcgcctgttcagggagcagctgttgttgctggacgggagggtggctgctagactgggaggttgcaccagcgcctatgaaggccgtcgctttccagtgaccataagggacgctgatccgcgagcgttctcctatacgggatcgaccgtagcggtgcgccatactgatgaaagcccagggtctcatcgttacaatgaaacgttccggatcaaggtcaagttggctgccgaaccagacttgccgccgcttcaggatgtcaggatacgaaatccgcgtactcttgtgtgctgctggcgatgcgcctgatgtcgccacccaagaatcgcctcactccttccttgaaggaagctcggccgatctcgataattgacgaccagacaaaacaatcgaggctcagttgtctgaggaacgccggttcctttgacccggccatttcaagctctcccagcggccgtgtgcgctctcatgcgccatgtctccagcatcatccaccgtacccgacttgatacgcattcatccatggcgtggatctttgccatccaaataaacagttatcgcaatcttctgaacggcgatagagaaagttgacttaaactgaaagagagaaggcgaaattctttcgcgatcgcttttagactagaggtgctctgatgccgggaactcggtaacttgagctttggaccgacccggatatgaatgacgagcggaactaccgatcaatttctcgaagtcctggaactacacgattggacttggcggaggatcgaactgttgcttctcccagacgccgcgaccgcatctgcgtgagactctcaagagcaggattaggaagtcggcctgacggacatatgcagaatggttctcgatactggaacaactcaaacgtggcgggatctgcgccagtttgcgccgtagccggtcttccgaggcggggtccggagtatcctcggcgcgtcgtcactgatactactcccgatggtcgggaggggatttcgccaatcaagctgggggagacgacgataatcctggatctacacgggcaagggctatcggtgtcagcgaccgccaaacagattggctacggattgcaagaatgtatagcgcggcgatcaggatgagacggcggcgacaatctggatgagactcttatgtcgcggtcggcatgaaggtatcatgttgattgtcgctggcaagggtctcatcgtgttctgattgtcgctccgcgacaatcagggaagcacttttggttgtcgcgaaggcggcgggtctgccgcggtggcgtttggcttccatggcggaacgtcgccgatagctttcgacgttcatttcgaagatcgttgcgtgatgaacaagtcggtccaccgcggcaagcgtcatggccgggtccggaaagacgcggttccattctccgaagggctgattggcggttatcatgatggaacgccgctcatatcttgcggagatgagttcgaacagcacgctggtttcggcctggtccttggtgacgtaggccagatcgtcgaggatgagcagatcgaacttgtcgagctttgcgatggcggattcgagctggagttcacgccgtgcgacctgaagcttctggacgaggtcggtcgtgcgcgtgaacagcacccgccaaccattctcgatcagcgcgaggccgatggcggcggcgagatggctctttccgccgcccggcggaccgaacaggaggatattggcacctttggcgagccaactgtcgccggcggcaatggccatgacctgggccttggagaccatgggcacggcgtcgaaagcgaagctctcgagcgtctttccgggcggcagatgcgcctcggcgaggtgacgttcgatcctgcgatgcgcccgttcagccagttcatgctcggcgatggccgaaaggaaacgagccgcaggccacccttcacgatcggcctgttcggcaaattgcggccacagcgttttgatcgtcggcagcctcaggtcattgagcatgatgccgaggcgggcttcgtcgatggtgttgtggacgtttttcatgcggcctctcccgcataagcagaccccatcagggcttcatagctattgagcgatgcgagctgcacatgcacggtcggcaactgatccgggtccggaccgaagatggctctcaaggccatcaggtcgggcagtttgcgggcgtcgagcgttctggcaagctcctcggccagttcacgctcgcaaccgcgatcatgagccagggccagcaattcgacggtgatcttgcaagcctgccggtcaggcagttgctcgatgagagcgtcgaaagccctgcgatattccggccgggggaagagcttgtcgcgatagaccaggttgagaagcgccatgggctttttgcgcagagagtggatgacgtggtgatagttgacgacctggtcatgcttgccgctcgcgtgggcgcgacctcgtggcaacgtcagcagatgcgtgccgccgatgaagacgtcgagacgatcgtcaaacaaacgcacacgcagccgatggccgatcaaacgggaggggacggtgtagaagactttgcgcaaggcgaagccgccggtgcgcgacacggtgacgactacctcctcgaagtcggtggtgcggcgctcgggaagcacctgcagatgcgggcgctcggcatcaatgcgcttgccatgcgcggcattgcggcggctgacgatctcgtcgatgaaggcgcggtaggagcgcagatcgtcgaagtctctggtgccgcgcatcaggagtgcatcgcggactgcgttcttgagatggccgtgggagctttcgattgagccgttctcgtgggcgacgcccttgttgttgcgcgtcggcgtcatccggtagtgagcgcacagctcctcatagcggtttgtcagatcgaccttggcatcggcatcgaggttgcggaaggcagccgacaggctgtcgctgcggtgatagagcggcgaaccgccgaccgaccacagggcgttctgcaggccctccgccaaggcgacgaagctttcgccgccaaggatgacatgggcgtgctcaaaacccgaccaaaccagccggaagtgatagagcagatggtcgagcggttggccggcgatcgtcacgctgaggctgcccatgtcggtaaaatccgacagccctagtcggccgggctcgtgcgtctggcggaagatcacctcctgtgcttcaccgtgaaccgcccgccatgaccggatgcgccgctcaagtgtgcggcgaatgccttcgggcagttccggatgacgccgcagcatctcgtcgtaaacggcgaccgcacgaatgccgggagcggccttgaggagcggaacgacctccgcatcaaagatatgctcaagcggatcgggtcgacgccgaccgcggggcggcttgttctgcgacggaaggcgctgctctttctccatgcggaacgccgtcgcccggctgatcgacgccttcgcggcggcgacctcaacagaatgcgtttgtcggtacttcatgaataatctcatctgatgatcggttacatggcgacccggcacaaaggtggttctccattccagaaaaccgccaccgtagcgggccgaccgcgatcatgagacgcctaaaaattgcgccgcggcgggggtgtaactccggtcgggctacgccctcccttcgtcacacccccaccgccgagtctcatcctgattgacgctgagtctcaccttgtttgtcgccgcgcaaagaatgcgcgcaactacgtcgagcgggggctagaggctccgaaatatggccaacgcaagcacacaatgtttggcgaccggctcgcgacctatcttcgcgaacgcgtgaaggcttgtcccgtccggaccgcgcggcggcttttccgcgagatctagggtctcgaccgtttctgcagctatacggcgctatccgggctgacaaggtgaccgggctcgaaaccggcgcccgcaactacatcaccaagccctttgcctcgccggagtacctggcccgcgtgcgtgccgcgttacgcgggccgccggaagcgtcactgcaacaggattttccatttcgatgtctggcgaatgggcgccgcttgcatcgaggaacggattgtaaactcaagctctctgcgagttcactcttctgatggcctttctcaaaaatcagtgtcctctcgcatgagcagcttctggggatgatgcgcgtcaattttcccttaattcgcgtcttcgccagctcgccagcgggctggtggatctgcatcgcctcctttcgtcatatggaggggaccatttcaaccttcgcggtgcttgcggtgcgctccccttcacaaccagtgatcagaatgctccaagcactccatggggcggtccggagccgaggtccacacgccgggacgataccgcaatgcggctgtgtatgctggcacgctatcaccagcaaaaaggcgcttgtagagacaatgtcccccagtccatgttgaggaggggagatattcgacgatggcacgttacgatgcccggctgaggggcattggaaaggcacatgcctgcagcgcgttcgcaggccacgatttcgagggtaggaacattatgaagacaccgtggaaatttcttgctcaattggcgtcgcggcgacgatcggcaagcgtgcaagagaattttattgcgcctgacactgatcccgaagtgatcgaaagcgaaacggaaaacaagtcgccacttccgttcgacaagccaacgcaagcttctggcactcctgatcacgattccgcggttgatcgcgggtcgatgttatcggaccagctggaaagcgaccccaatcccctgcaggaaatgaacctcacagctgacattcaagagcctggaacccctgcccgaagtgaaaccaaacaatcggatgcggctgggaagaggctggggccgcaaagccagacaagcgcaaattcccaaaagaagccggagatcagatgtcgagaacgctccaagaacgcgcgcgccgagggggttgcgcagagcgctgtcgccacaaatgaagctgagaccgtacaaacctcgtcgtccggggatcctttcttcaacgaagtggcaatcctcgacgaggaaatcaaagagctgcgacgtctgctggctcaaaaactttatctgcagaacgctcagctcaaaaagatgcttgagcgtttcgacgcctcgtgagttcgcgtcaactgacgccggaccgagaaaatgctgcaggacgttattcgccgcgagttccgaggcctgctcgaaagcggggaaccagtggtgtgcccagccgacggtgaaggtggagcagtgtcccgtcacggccttcgacgatctcgaggagattattttcgcgcttgatcaaaagagaggttcggggcgccaatcgttcaggatcaacagctgaaaatggtgcgcggcaggcgcgcatatcgccctccacgagcaagcgtcagttgggcaaacggccttgcgccgcactggtaaaggacggcgcaaccatcgcatcaggccttgtgcccgagcgcaagccaaccagctctctccgacgccggacggtcctcggatggccagatcgtcgtgcgcatcgatccagtcgccgccaatcaagcctcatgaacaacgcgatcccggctgtgttcgcttcggcagtggcctgatggcgtagcccggcgaacctgaggcgtgcggcgagcttccggggcgcgaaatccagtcccgttcgagattaggcgcccaagcatctttcgttgtccttactggcgatagcgggtccgcagatgtttgtgtgatagatcggcttatgcgcgccactccagctgacacagcgcttcagtcgagatgattggcgacgatcggaacggaccagaccgtggaattcgtgccctgattcccaaggcacgagcgcaggcgtgtgtcgaagtcgactgggcgcctactgtgccactggatttgtcgagttcccgacattcgggaggcgagacatagcgccaccgaagtgatcgcgttgctttggaacgattttcaagcttggcacgacacatgcatagccatccacatacacgctgcgccgccgcgctggagattccgaagcaatggtgaagaacttccttggatcatcggttacatcaggctcggctggagcggaacatggaaagactttgcaaattccgactttacgatgggtgcgccagtcgaagacttcgatcatggcacttgtaatttgtctaggcaggatagtgaaaacagcactcgttaccggcggctccggatattttggggaactgttaagcaagcaattgcttagacaaggaacctacgttcgcgtgttcgacctgaatccgcccggcttcagtcatcctaatcttgaatttctcaagggcacaattctcgaccgaaacgcggtcagacaagcactttccgggatagacaaggtgttccacaacgttgcgcaggtaccgctagccaaggaaaaagacctattctggtccgttaactgcggaggcactcagatcatcgttgacgagtcggtcgcgacggggatcgaaaagttcgtctacacgtcctcgagcgctgttttcggtgcgccgaaatcgaaccccgtaacagaagaaacagaaccgaacccggcggaagattatggtcgcgcgaaactcgcaggagaaattatctgtaaggaagcaatgcagcgtgatggcttggatgtggcgattgtgcgccctcgcacagttctcggatatggccgccaaggcgtcgtccagattctctttgactgggttgaacgggggctcgatattccagtgttgggtgggggtaataacaaatatcagttcgtgcactcggatgatttagcatcggcatgcatagcagcctcgaatgtaaaggggtttgccacatacaatattggtgctgccgagttcggtacgatgcgtgaacttttgcaagtggtaatcaagcatgccgaaaccggaagtcgaatcaaatcgatcccgatgggaccgactgcccttgcagcgaatctggcaagcgcgctcggcctctctcccttagggccataccattcgctgatgtatgggagagcaatgtatttcgatatctccaaagcgcaaaaggaacttgggtatgcaccgagatactctaattctcagatgatgatcgagacctataattggtaccaggctaatagggcttctctcggaaaaggcggagggtcacgtcataaggcgcccgtcaaacagcagctcctggcattgcttccctatgcactgcggctgatcccaggatgaacgcggttccgataatcttggtttttgctgcgggcctgaattcctgtattggcaatatattgctgaaatggggccgggcctcactgcctcccagcgccggacttgccgatacgtttctcactcccggctttgtaggcggggtggtattttatggcattaacgttctactgtttgcaaaggctctggactccttggaggtatcagtcgcttatccgattctggcaggctccggattcgcgatgcttatcatcgcgtcgcattatttttttggagaaccattccaccttcacaaatggatcggtgttgccctcgtcctggtgggcattatttttctggcgcgaggaggctaagttggcattcgatcgagtgatcgtggcaacattgacacctttatggccattgctcgacgcggaagaaaggccagcggtggtgtcagaagtcgcacgcagtgtgacccgttccatcgcacttgccccatttcacattcgctttgcggtcgaaagcgtttcgatcgtcataggtctctgcactgtcttgatttcagcgggtgcaggcggtcccttggcgcgcacgctccgaacagacagattttatcggctcctgcaaagaatgcccggtcccgccggttctgtcatacgcctttatcgctcgatgacgctgcttgcattttatgatgaagcgccggtagccgaaaagctgttggctgcacggcctgctcaaacctcataggcttgaatatgaagggcgggttttcgttgaacagcgaactgcaactggaagccgatgcggtgataatcggttccggcgcgggcggtgcaagcgttgctgatgtacttacagctgccggtttatatgtgatcatgcttgaagaaggtgggcatgttccctcatcatcggcttctcctttcgcgagtgaagcattcgcggcagcctggcgcggcggaggattaaccgcggcgatcggccgcccccctattgcttatgcggagggccgctgcgttgggggagggacagaaatcaacagcgcgattgcccagcgcgccgatagcgacctccttgatcaatggcgcaagctttacaagatcgagaattttaccccggacgaactgtcgcaatattatggtcgcgcggagacaacggtgaatgcgagcctgacccccggcccactcgggcgtcccaccgacattctgcggctgggtggggaagcgcttggctggaaagtttcggagctgaaacgggggcagcgtgactgcaagggcgccaatcggtgttctttcatttgtccgaatggtgccaagcagtcgatggcggtgacccttctcccaaagtcgatggatcgcggcatgcggctgcttgcgcgaacgcgcgtagacaagatccgtatcgagaaaggacgtgccgcagtggtcgtcgctcagttgcaggacgccggcggacagggcgtgcacgtgcgcgtaaaagcgggacttgtgtttgtctgcgcgggagcaattcatacgccagcgcttttgcgtcgttctggcctgcgtaaacgcattggcgataccctgcgcattcatccgacgatcagagcgacggcactttttgatgaacccgttgatgcgcaccagtcgcgccttccgctgacagccgttaccgaattcatgcccgagcagcgcataggcgggtcggtgttcacgccggctgtctttggcctttcacttgcggaagactggaccaatcgcggcgatctgatgcaggcttggcgtttatgcggctcttattacggcatgatacgaccgcgcggagtgggttcagtgagacctcttcccggtattaatgaaccgcttgtcagtttcaaactcgcgcctgaggactggatctctttgggccaggttctcaccctcctcggacaggcgatgtttgcggccggtgcccggaaggtaatcccaagtatatcgggccacgagggctggacaaaccctgatgaggtcgatgaattccggaacaagcctctgcctgaaaaagcgaccaacctgatgaccatacatctgttttccacctgcccacccggcgagcatcgggacgcttgtgcagtcgacagttacggacgtgtgcggggcgtcgaaaacctctttgtcgccgatggcagcgtcattcctgaggcgcccggcgtcaatccccagatgacgatcatggctctggcgttccggatagcggaagcggcactcagtcattcctctcgagaacgcgcccaatcggccgcaagggagtaagtgttatacattaaggtccagtagtgaggaccgggaattgcagcccaggggaactatcgataaatgcgccacttgcccttcttctcggaaacaagcttgtagactgaattgttgtccagcaccggtttgccccacaaaccatctcttgaagtgactacaagagttctacaacgatatttttccttcataattctaagatggtcttctgttgccaggccggcgaaagcgcgtacgaagaaattatagatctctgatgcttttttaggcgtcagttgagcagcataggcgcgcaaaaaatcaagcgtggttccgcaatgtcgtctctgagacaaaattgcccaggagatatttgccggtgtataggtcacacttgctagatcaagcgggttgttggccaccgcttcattcggaggcgttacctcgcggacagctttccacatctcaggggatgctttgaaagcagtgccttcttctgaatcaggtccttcgacctggaatttgaaggtgttcgaatagacagacttggcgccaaccaaaattgagggggcgagtaaaataatagctgttatggttgtgaggcgcccaactagcgtgcctttaccgatagttgtggagaaaagcccagaagtcagcgcagtcatgacaagcatagatggaatgagtacacgccatcctaaatcattgtacataattacgctatggagtatctgtgtacaaaatagaggcgccagcaccgagacagttaaagcgcagtcaatgtgtgcgtatcgcttactgtcgtcagagggtctggcaaaactccagatgaggaatgataaatatattattccgaactcaagaaagaccagaacaagccagaatcctggaatgtccaaaaaccaataatcgccggcaaaaatgggaaaaacccaaaactccacgaccttcctagtgtgtaatatagcggactgttcgcgaataagcacggctgcacagagtagggttatgacgactgtgaccgaaagtgaaatgagaacctccagaagccgtttgacctttagcacatgtgagaccgacagcgcccccacaaggggtaatatcaaaagcagcgataagctgcccgcccacatcgagctcccataagcagaagccaagattgcgcccataaatactgccagagccatattgcgcccggcgttggaatataaaattcgcaggtatgccatgatggcaatcagggccagcgtcccggaaaagacgtgctggggtacccagggggcctggataatccacgtttggaggccatgttcgggtgccatccatttctcgagccactttccgaagacaaatcgcacggctggcttaagcgaaccgacgaataagagcgggagtgaccaccaagcggcatatgcacttctgcttcgcgccacagccagccaagttacgacaaacgtggagaaaagcgcggtcatgccggtaagagcgatgtcggcctcccagccggttgcgcctgttatcacggatgaacaggcggctatgaagtgccagacgtagtagtaaattagggtgttgggagatccggcttcggaatggaatggattggcgggaggcaatccgttttgagcgatttcatttacgatcgcgatctttgcatggtcccagatcgggtgaccgacgccgacgctacctccataatgctgcggaatgatctcgaaagctggcaaaaggcagaggagaaacgcaacagtgaaccagcaaaagccgggactcgcaggcgatcgcaggagcgggtctatggtgcctttcgagagccagaatgcgacagcggacaaaccaaggacgatcagcatcaggttgatcgctgtaatgggtaaaaaatgaaaaatggaaacggctacggcgccgaatatcccaagtccgatgaccggcgacagaagcaggcgcatcgtggtgttgctgtcaaaatacttcgaaacaggccaacctatggcatatcctatagcacttgaaacaagtgcgctggagacaattgaagaagtttgcaccagcactgacggcctcacagctcctcggcaagcttgactagaatgactgaccgtttttgacgcaccaatcgaccgaacgttgcatgccctcgcgcaacgcaattttcggggcgtatccgagcacttttctggctttggtgatatcgcaggcaattgtcttgttcatttccgacagcacatggatcttctggtgatagatcccggcatattggagggtagcatcaagtatcgttgcggcgccgcctacgatgtccggcagacggaaagggttgggctttaccgtcatgccgaaatcttcgtgcaggaccattccaacgacttcaatgatttcgttcatggtgtagggcgtctcgtctgcaagccagaaaatatctcccgcagcccgctcgtgaactgcggccagaagaatgccctgagccaggttgtcagtgtaacccatggatcggcggttccgccctgatccaataatgggaaacttgccttctttgaccatcttgaaaaaaagcgtttgccttgaaggctgattgggaccgtaaaaccagggcgcgcgcacgatgacaatctccatagtgctgccagcagccacttccgcacgcagtgcccgttccatcagcatcttggagcggccgtatcccgcatggggatcataggggctttcctccgtgaatctgtggtccgagtgaggattgaagccgaccggcgaattcgacgacatgacgacagcgcgccgcacacctgccttttgcgctgcagtaacgaggttgatcgtgccctgtgtgttgattgcttcaaactgggcaacatttttgggatgaatgatacctgccatgtgaatgagaacggcgccttcggcgccggcgacgaacgcgcggacggactgcatctcccgaaggtcacctgtcgcgatttccatgccctgtttgcgcaactcagatatgtcttctcccttaggcacgagggcccttacccggaagcttccgtttgcgagaagtcctgcatccggcaggcccgtcgtcaacgcggccgccacccgcccgcccaaccagccggcagctccagttaggagtacgagcggcgcattcaaagttataggggttatctcttgcatattggcatttgcttaatttcacatggccatcacgaacgccgacgcgatgagggcgccgataaaccagctggtcttgtcgttgagcgcgaagacaatagggtcgtcgtgcaattccatacgatgactgaggagccagatcctttgcagccaaatggaaacgccgagcggcgcaacataaagccatgctggattatgatataggtgcgtcactctgggctcgagtgcgaggaaaagcagcatgatgacgatcgaggccgaagcggacgcaaggccatggcccaaggttagcggccagtcgccaggcaagtatccgcgcccttcgatggtgtccttgcgatttgagcacgcgcgcattgcttccacatgacgctttgccagagccagcgaaatgaagaacattactgaaaacgaaaaaagccaaggggagaatgccaggccgttcagcacctgacccatgacaatccttaaggtgaataacgccccaataactgtcacatcgagtaacgcaacacgcttcaggcggaatgaataggccagtgtcagcgcgagatagacagaagcaaccagcgcgaattgatggtccaaaaggagggccgtcccaatgcctgtagcaagcataaccagacacgccagaaagccgttcatgacactgattcggcctgcagcgattgcccggaagcgtttggtcgcatgcgcccggtccgcctccagatcagccagatcgttgataatataggttgccgaaacaatcaggccgaaagcgagaaaaccgaacgtcgttttcagtacagcatggaagtcgtccgcaatgcggccgagaaacagaggcacgaagatcagcacatttttcgaccactggtgtatcctgagttcagaaagccaatccttcaccggatgacttttttcaggactgagcgtcctaacctcgacgccagcctcacggagtttgctttcgaactttactccgtcgccaaccagaacggctccggaagccgcctcccagatcggcaggtcggcggcactgtcgcctgcatagatgaatccctcgggaaagctctcctgaagccattgcagtttgcgccggctcttgaggttcagtgagccactactccccttggcaccgtcgaaaccgccgagatgagaaatgatatcatctgctatgctctgatcagctgccgtaacgagataggtttcacgcccggcagatctcgcgcggcgtatcaggtcaagcatctgttcacggtagggaagcgcctgcggctcaaccgaacggactttcgccagagcttccttcagggccgggcgccccttaaaccagtttggaatcgtgcgaagcaactgctgcggggaatggaagaaggcatcaaacaggttctcgtgaagactgtctgattttatcagtgtgccatccaggtcacaaatcaaaggcaacttacgatcaaagcagtccagatcaagcaccttcatttcatttcgccgctgtttcatcagtagcatcctccagccggacgccccgaaacaggtccaaagtacggcgggcgcattttcgggaggtggtgagcctggcacgcgcgttctggtatatgagctgacgaggacatctgctttttgcctctctcaaacgaccgctaagctatccatccccaccggggtcggtatctccagacgcatgcgacagaggagcatcaaatgttgtgccagcttgcacaaacttatgggaagagactttctgtatattgttcaatgacgtgcatgcgtggcgcctgatctcagctggcgagcgctgtgtcgcggacacgacagaatggacagcaggtgtctcttgtttgacgtttacaggaaccggcgccatagagtgatcagtgagcgggacgagggagcttggataaccgcggcattccgctgtccgccagcagtcgctgcacaagtcggtacccaggcggccagcttctacaacgacgccgaacgcaaggcgggtagggcgcgcggcttgtcatctgagcgggagaaccgaggatgctcgtcactcggctgaaagaggagctcgcggccattcagaaggcacggcaaagtactgaattggctgacactccgcgacggaacggcgcaagagtcgcggccgcaactgcatccaacctccgaatgtccaattcgcattccggccagctgcgatcaccattatagggtggcgaactcgtcgcgaaatgcgtctgagtgtggatcgatcttcggaactcattgcggcgaccccagccggatgggaatgccaatccccaagatagtcgaggtcgcccgcggtgttcctgaatgcttcgtctatctgctcgacctgccatgagtggtccggaatgaaagtatggcgaccatgcagcgctttcgggccagcacctacaatatcaacgacaacccgatcttcgccatctctccaaccgaggagaacaccgccggtctcgagcggaaagaatatgttggcctgttcgattattacttgagctgcgtcgcgccccaaccaaattgtcatccctgtgacgctccgcagctgcagctcgaatgtggtgcgatcgtctcggctttccaccgcgggagaatgcggcggccattttcggtcagatcaagaatggaaagctgccagtcacccgaatcgtacacgtccggggcgagcagtccgatcgtgctgcgtacaacttccatcgacacttcctgcaggtcaaaggcgcctccggtgaacgttggcgcgttgcagccggtcggaactatcgtgcccgagctgtcaatagttgggagcgggagcgtcttgccggaccaatgctgctgcaagcagacataacaacccggggctcccggtttgaatctcgccacaacgcctccggccgcgccttcggttgcgtggccgagtacgtaccgctttcctatgctacggcacatgtaggccaaggcgccctgacactcggtcgaggccgaagtgtctaccacaatgtcggcgtcctcgatcaatgctcgaagccaacgcatgggattcccctcgagtttgcggacgtcgtccacattcgagattgctgagcccactttagcgtgtccacgcccgacatttgtccaagggtagttgtgatagaggaaatcgtgcagcgcggttgtctttggcaggccccacaccgaacgacccagcgcccatctgaccgtgttgccaggctcgacgagatcgaaatcgatgatcgtcagctgaccgacgcctgagcgcgcaagctcgactgcagcgaaactgccgatggcgccgcaccctacgagaacaacctttttgcttttcaaagcactcgcgacaggcagtcgcgagagcatatcgctcgacagacggtatccgcgcaccaaggaaacctgtcgccggcggctgccaggcacgcgccgactgacgagaaagaaccaaccgttgcccttgttatcagggccgtaggaaagctcctcctgaaaaaccacggcggtaatcgatagatcgtcgtcggcaattgatccgagcttcttcaggtgagcggggaagagggccgattgtcgctctatcgccttctcggccgccgccaaaatctcctccggggcctcggggaatggcggctccaggcgtatccagcgcccgatgacgtttttccatgggccggcccgtttcgggagatcgaagggcttcgccatccaggtgccgctcaatggctccactttgctcagaatggcttgaaacggtggagaccttcctcgctccaggcggtcctggagcaggaaaactgcggttccgaggggggcatttggaacggtctgctgcccatcaaaaaagaccgccgaatactcctcggcaacatgcatatgatatggcgttacagggtcgggagcttgttcttcgaggctggctgcctcactccactgctcgttccgccgcagtgtcatgacttgcaggacctgcgataaccgctcggctatgaagtccgcgaccatttgatgggggtaccactgggcagagtcctgcgtcagcaggcacaaatccctcgtaaagggattctgatgccgctcgagttgcagttcaggcgcggatatcgagggtcggcagaacggatgcagcggcgagtagccgacattaagtcggatggacccggcactgtccatcggccaaaggacctcgaggatcaaggtgccgtcctgttggattaacggccggtgagaggcgccgtgcccctcataggccgccaactcccgggcatacaagccaggataggcctgccaccaattgtcctgatccgagccgcgcttaagaacgttcacctccgtcagccgaccggccggtgggacggggggtgagagggcactggcgggccatcggggcgacccggagtatggctgggcggccccttcgggacgtcggggtgttcaggatgaccttcccggcccggcttattcgtattcgacatgagtatctccttacaatacaggcctccgttcttgacggagtccaattccggattaaaattctggatgagtccagatatggattatataagaatggactcattcgttgttcaagtacacacttggacttaggagcagatttttatgacagaaccagttcgagggtcatctccaagcagcgattctgctcgagtccctgcagaactcgaagcgttcttccgcattgccgaccggtggcgtctgtctgccgacgatcagatcaagctgttgggatctccaggtcggtcgacgttcttcaagtggaagaaggcgggcggcacgttgcccgccgacacggttgagcgcctgtcgcacattctcagcatttggaaggcactgcgaattctctttaccatagaggagcgcgccgacgattggattcgccgacccaacgatttcttcgatggagcaagtgcactcgacaccatgctgcaggggagggttgtcgatatctacagagtgcgccagtacctcgatgctcagcgtggcgggtgacaaatggatgaggtcgccatcaaggacgagttttatcggctaattccgtcacggttcccgccagtcgcggtgtacgagggattggtcagcgaggacaagatcgaggcacttgtcgaaatagagaacaagacgaatccgcgtctccagtcggagggccggctgctatccgctcataccgatccgagggcgccgaggctgcagaactggaacctggctcccttcaagtacctgaacccggagggaatccgctttttcgacggtagtcgcccggcactggaattggcagacgatcgtcagaccgcgctcgctatgtctgtcgagcgtcgtcaggccttcttgtcgcgaaccaaggaagcgccaatcggcctcgatatgcgattgctcaagacaccggtgagcgggcggttcatcgattttcgaaagtatccgatcgatctatcgtgcgaggaacgctggagattgggaggttcggtgcccgaaggcgcggacggcgtgatttatcatccgccggagcggccctcagccatttgcattgcggtactccgaggcgacgttcttggccgaacgattcagacggtccattaccgctacgtttggaatggtacccgaatatccctcctttatgcctttgatgatgcaggcaacgaaattcgcccagaggtattgggtggcgcggatgatgcattcgccgtgtgagcattaaatctagcaaaacacacctacattccgcttaaaatcgatttcgccttctgcttattcacagtgatattctcagcaggcaactctacccttctcgtcgctttgtgacctcctctcgaaaccgggaacggagtactctcatctcggccttctctaaacgcctgctgatcttctcagccgtctgggccaggagcctgccgtcgaattcggggggaactcccctgttgtccttccagaagattttaattgcctgaaggtcggcctcttggagatctgcgacgaaagagcacgcggcagcaatgataagtccattatcatcatcggcagtttctgcggcgggtaccgccgctttggcgggcgatgccgctatagcggtcattgcaggctggtgaacggaccgcagcgacagaaacttttcgacggtgagcttgtcccattcagaggtggtgtcggcttcctgtctgagggtcggcgactgcgatcctcgcgccggatgaatgcccagcaaatgaacccgaaccccatagttctgagcaatctgcacgccgactcggacatcttcatcgccagacagcagcaccacctcagagatagccctttgccgtgccaactctatcaagtcagtcacgataagcgaatccacgcccttttgctgcccctgcccattaatgaacccgaggcgcaacttgatgtcatccatgtcggcgatggcagtctgatcagcgctcatcgctgcacctggtcttattccatcgtactagtaaatgcgcatcagtgacccagtaggggctttcgtggaacagaacgccttcagttcctcaatgactgacctcgccgagagtgacaacttcgccctagccactttgttaccggtgagtgcagtgctcccctgcgggaacagatagcccgcgtcgacgaaaatagcagagcgccccaagatcccccaaccctaaaagtagcaagggctcccgcgggagccctttgtatgccggcgcaaccataatatctaatcggtcacgccggagtaatttatgtatgcgccacgcatgcgcacaagtcaatacgaaacgataaacgctgcaggaaatggacgctaatgagacgcaacgcacgccaatcagacctaatcgcgctcaattagatattctgcatatacgcagctgcaacaagttactacggatataatgccgcgggcgctgcaacgcaagaggccgaagcagcctgcatcgcgcaaaatcaatggctatcgacggacaggcgccgcaccgaccagtccgcttaatttccggcgccggccgaaggcatccccgtcagactgcggaaaatgtcgacccagaatgcgaaatcgtctgctcgcccgtcggtccaggcctcaagaccgcaatgcgccacggcagtcgctgcctcgtcgccgaacaggtcaatcgcggcttccatcatgctttccgggtccgaaggttctggccagatcgccttcatcatagtcatacacctaatcgctgcttctcgggcgtgaggatactacgcgcatttgagcgttgcgcaaacgatcgtttatacacgcgttgcacaggccgcagaaaacgcaatgaaatcagctgcctagagccgcgtatccgggcaggattgcataagcatgctccattacgcaacggggtatgatgggcgagaagaccggatatgcaagggtttccaccctcgaacagaacctcgatatggaacagcgcgctctcaaagcggcggcaatggtcacgtccgctgcgcccctggtcgcccctcgacgggatcaggtgaacagcattatccgatttgcgcgcagatgccctatcaactcgcgatcgatgtcgcttgaggccgccgacggccacagagaccttaacgagcgaaccgttgtcgcgatactcctcgagcgtgaagttattgaccacctgcttgcggatcgagatcgagccaccttcgggtgccgcgcggcggcaagacgatctggatacgctcgccggtcggaagcgcggcgctgaggatcggtttcgagcggctgatgaactggttcgtcgcggccgcaacacgctcgccgacgttctggatttcatcacccatcagggcgacgattagatgatgctccatgtaatcggcgccaaaccgttccacatatacatcgcccggtttgttgacggcgatttccaccaccctcggatcgtcgataaattccctgatcggttcaagtgcggattccgacgtgaagccggccgcattccgatcaatatccggccaccgttccgatttgaagccggccacgattccaatcaattaccggccggttttcggctctaacgataccccctgggtcagcaactttggccatcaagcctccgggtacacgaggagatattgatgccggcgaagagaaggctgaccatgagacaattacgacaaatgctccggcttggcggaagcggaaaagcagccgcgagattgcggtgatgcttggtgttgcgcgcagcaccgtgcaggataacctgaagcgggcggcgttggcgggcctgacctggccactgcctggcgaactgaccgacgaggcgctcgagcatcggctgttcgcccgcgccggggtcaagcagggccaacggcgacgccaagagcctgattgggccgagctctccatcgaactgaagaagccgggcgtgacgcttcttatgctctgggaggaatatcgcagcgtccatcccgacggatactgctacagccgcttctgcgaactgttccgcggcttcgagcagcgcttgtcgccgacgatgcgccaggagcacgccgctggcgacaaggccttcgtggactattccggcaagggggtgccaatcgtcgatcgcaagaccggcgaggttcgcgaggcggaactgttcgtcggcgtgctcggcgcgtcgagctatacgttcgccgaggcgaccttgacccagacgctcccggattggatcggctcgcacgtgcgcatgttcgccttcttcggtggcgtgccccggctgatcgtgccggacaacctgaagtccggcgtcaaccgggccaacttccacgatcccgagatcaaccgcagctacggcatgatggcgtcccactacggcgtcggcgtcctaccggcccggccgcgccgcccgcaggccaaggagcagacatcacgatgcaccttgttggaattgttgagcgtcaattaacctaggtttgcggctaccatagcgaccgcctacgccttttgcgagtctaacgttagccggtggctcatacaggtagcggtggttggtagcgtagcgatggcgctttagaacaccctcgcgtccgagttggtgtacggttgtggcacttacgccaaatcgacgagccacttcctcgccagttagcatgccactctcgcgcaaccgttcgaaccgggtcttcagcccataggctcggcgaacgagcatgactttcttcaacgtaaaagcctcaccgcgccagttacgatgcccgagtgcgttgagacgactggcaatctgctggtcgttgtcggtctccagaagtttgttgatcagtgccacaaccgcttccggggtcttgcggatcacggccatgggccggggacgagctactgccaggctttgcgtgcgacctccgcaatgttgatctgctcgtcgaccagcagtgtcacgtcttcgatgaggaggccaagcatgcgtttacgctcgaccgcgctggtgcgctcgttgttccagatgcgcggaaaatctgcggccagcgctcggatccgttcctgcatagcgccgtccagcaatgactggtctgtctcgttctgacggtcatgttcgcgctgaagcgtatcgaggtcgcgtagcttgccattccaatccgcttcgagtgcgtcggcaaccaagcggttgtcgggatcgaccttcagatagcggcggcgtgcgagttcagcctcataccgggcgcgctgtaactgcttgtcgcgcagcgaggcagcttgttcgacacgttgtgagatctcctcctgcaccgcaagcgcgacctctatcgccgtcggtgccatttgcttcgagcagcaacgcgctgaccgcttcatcgatcgctggtcctcttgcccattggcaagccttgcccgcgtggcgcacgacggcctcgttgcagatgtaatagggacgaagcttgccctcgaactgttcataatggacccgcatgcgggcgccgcagcgaccgcacaaaactcttccttgcaataagccgttgccctgacgaggcatacgaccccgcaggcccggagaaaaaccgactgcattttgttcgagacttgtttgattgcgttcgaactcgtcccacgagatgtagccttcatgggcctgagggatgagcacctgccagtcggacctcggcatcttctgctgtacggacttaagcttggcattgtagatcgtgcgtgtgcgtccgtatgcgaaagcaccagcgtatcgtggattgtgcaaaatctggatcacgcgagaatggtcgatctggctccacaggacgtcgcccttgccgatgccgcgacggatacgacggggaaacaggatcttctcgctgcgcaggcggcgcacgaccgcacaggctgagcccacctcccggaaggtatcgaacagcatgcgcaccgtgtcctggatctggcgatccggatcgagcaccacgcgcatatcaggcgtgtagaccagtccgatcggcaacggtaactcgagctcgccacgacgcgccttgttgagaatgccgccttgcagtcgagacttcaggatgtggagttcggcctcactcatcgtgcccttcaggccgagcagcatacgatcgttgaacgacgcggcgtcgtaaacgccatcttcgtccatgatgagcgtgcgcgacatggcggccagttccagaaggcgatgccagtcagcattgttgcgagccaggcgagatacctccagccccagcacgatccctgcgtgccccatcgcgacctccgtcaccaagcgctgaaatccatcgcggtcctgcgactgtgcgccggaaaggccgaggtcgttgtcgatgacgtggacgcgctcaatcggccaccccagagccaccgcgcggtcccgtaatgcatattgtcgcttcgtgctctcggtgttctcgaacacctgacgaagggaggattggcggacgtagagaaatgcatcgcgccgcaggtgatcggcgctaatcttcatggcattatcagtagacatggcttcctgtctctgctgccagcaccatattggcgagcatgtgcacgagctggcggtcgtgcgcgaccattgaagttgtcttgaaccgaggcgctgactgctgtcgcgctattgcggattgatgtggtgcgatcagcactgccaggccgcgccacagtccgtgaaagacgatggcgcccatgcgcctcgcgcaagccgtgccgcaaataacatcggcgcggagcgcttcgtaaacatccttgccgttctctgacatggcgattgcgtgggtcggctcttcatcgtttttttttccgcgccaccgcgcgttcgatgctgcgaggatggacgctgatgcccagtctcgaatgcaccaggtccgccagagaacgggcctgcagttggccgttcgcgtcgagatgctcctcgacgagacgcatgacctcgccagtaagcttgtgggctgacttcggcccacgggtgcgcggcaagaggccggacatgccatcgcgctcgaacgcggcctccgcttgatagtaggtctgccgagaaagcccaaaaagcgcggccgcatccgctttgttggtgccgtcttcgcgggcgtgccgaagcatctcatacttcacttgcacgagatcgagcggatcaaagaaacctgcttcccggaaccagggggcgcggacgctctcgggcttggggttcagagcgcccatctggcgcaggcgatcgggcttgctttctttggtcatgggagcctccttgtgtaagataaattatgccgcacttggctcgcacgtcaattaaattatatcgctaatatcgccgatacgcatgcatcacagggcttcactccttgctttgatgatcaaagacatcgtacgcccggcataattagccttacatgtgcggcgtagtttacttgacgcttcgtcactcttcctgacggcgcttaatgcgatcgatcaacgacgccagcgccgacagatcgtctgggcgggagaaggaccgacctgcagcaacctgactgaacaagtcggcctcattaacatcggtccacgaggccggcagcgaacgcaaccgtccttgagcgtcgtaaaacatgacgcggtcttcgccccagttctgtttgcgtgtcgacagcacgaagcgctgtccgcgccaaggatggaacgggtgtgtgacctcgaactctatgcgggcttgagtgtcagtacgaactgcagtcctggacttgaaagaaggcgaagctcgagaacgccgtgcgctttgcccagagctgcattctcggacgcctccgcaagcagaccttcttctcgctcgccgaggctaatgccgcgatcgccgaggcgctcgcgcgcatcaacgatcatgtcatgcgccggctcggcgtcagccgccggcacctcttcgagacggtcgaacgcccggcactcgcaagcctgcccgccgaagactacgagttcgccgaatggcgcttggcgcgggtctcgacggattaccatgtcgagtgcaagagcttcttctattccgtcccgcatgccctcatccgccagcaaaaaggcgctgaaaagtgatgcgataagcgccctttacgaaggatgatcgatcagccgtttcaatgtcgtcaagatcgaagagacgctgacgatcgaaaagtttttcccagctacgccgcacacgagcgctcctatgttcggatccgttgctccccgttgctattccgcgcaacccatttcgcgcgcccactcgataagtgttcggctctcgcggatgaatgcgcatctcagacgctcgccttctactccgcctgccttgtccttggtgattgaacttcctcaaagggcctgaccgttacccaatattactcaatcgtagggctcatcggcgttgaatgcgtcatgggggtgccgtaagccatcatacatggagcgagaggagaaggcggtcgagggggccgcagatgcttcagcaaggaggagatatgaaacgtcgtacattcaccgctgggctggcggctttgccgttcctcggctccagcctcacccgcgcattcgcgcaagatgctgccgcctcgctcccgaaaacctattcggggcagaagatccgagcgctggcctcgaccggtgctgccttcgaagcgatggctacggtcagccgagacttcaccgaggcgaccggcatcgccgtcgaatacgtcaacctgtcctataacgagcagtaccagaagctgatcctcgatctaaccagcggtgcggcgtctttcgacgtcttcaacttcgcctatcagtggaaattcgagatcgagccgtattgcgccgatcttgcgaatattccgaaggaaattcagggtgcgccagatctcgcgcttgacgactatccgcaacgagcactcgaaatctacggccgtgccaacaacaagctcatcggtctgccgacactcggcgatgtgacgctgttcgtctggaacaaggaggcctacaaggccgcggggttggatcctgacgccgcaccgaagacctgggacgaagtcgtcgagcgcggcgccaagctcgtcagcaacggccaattcggctacgccatgccggcgggcaagggcattcaaacgaccgtgacctggatcatggtgttcaagtcgatgggcggcgaatatttcgatgcgtccggcgccccgacctttgccagcgaagccggcgtcaagacgatgaaattcctggtcgagaagctggcggcggtcagccctcccggcaatcttgcctgggatttcccggagatgttcaacagcctgtcgaccggtcagtcggggcagtcgatgatgtggcccggagctttcggcgatctgctcaacccgaagaggtcccaggtccacgacaaaatcgggtggtcgccgatgccgcaagcttcactgttgggtggctggtcgatgggcgtcaacgatgcctctcggtcaaaggatgccgccaagctttacgtggcatggctcacatctcccgacatcgttcgccgcatgggtcttattggcggggctccggcacgcatctcggcgctaaaggatccggagttgatcaagcaggctccgaaccgaccggctgtgcttgccggtctgcagggcgacgtcgccgaatatccgccgatcaaggaagcggagcaggtccacatcatgatctatgatgaggtgaatgcggcggtggcgaagatcaagacgccggaacaggcggccagcgatcttcagggcaaggttgagtctttcatgcggcgccgcggctatctcaaaacctgaggtcgcgctccgtggggggcaggcgttcctccccgtctgccccccctttacaacggcaaatctgcaagtagtttacctgatgacaatctctcaaacagttccacggggcgcagtggcggttcgccggcgtcgccgcatccgcatcagcactgtggtgtggttcacgatgcctgctgcggcaatcatgttgctggtgctcggcgtcccgctggtctactcgttctactacagcctcactggctggtctctcgtcgttcccggcagcgatcaggacttcatcggccttctcaattataccgatgtcttgaggagcagcgagttctgggcggcgatccgcgtgacgctgatctatgccgtggtcgcggtctcgctggaatgcgcgctcggcatcctcttcgccgtgcttttgaacctagaattcttcggccgcggcctctttcgctcgctgatgctgatcccgatggtgatcaccccggcggtcgtcggcatcttctggaagctgctctatgagcaggattccggcgtcttcaactatctgcttggaaccctcggcttcgagccggtaccgtggctgagcctcaccgtggcgctcgcctccgtcatcatcgtggacgtgtggcagtcgacgccgttcttcacgctgatcattctggcggggctgcagtccctcgaccgcgacacggtgagcgccgcgcaggcggacggcgccaatgcgctccaggtcttccgctacctgacgctgccgcatctcgtcccctatatcatgattgccgcggcatttcgcattatcggcgtcatggccgacttcgacaagatcttcctgttgacgctcggtgggccgggcaatgtcacgacgacgctcagcgtctacgcctacaacaccggtttcaaggtcttcgatatcggcagaaccacggcgatctcgtggatctatgtcgtcttcgttctcgcgatcagcgcgcccctgatctggcgcctgttccgcggcgcaagcgtcaaccgccactaggggaggtgaggcatggctatttcatccaacaccagccgcaccacccgcaagctgctctggaccctcttctggtgcgtgctcgccttcgtctatctgtttccatacacctggatggtgctgaccggctttcgtcatggcgtcgacacgatctcgatgccgccacgcttcatcttcgagccgacgctcgccggcttcaagcacctgttcgaggtgaccgggtttcagaaatacatcatcaacagtgcggtggtgacgattgtcagcgtcgtgctggtgatcgcagtctccgcgccggcggcttacgcgcttgcgcatgtcaccaagcggggcggtactctcctggtggcgatcctggtcgcccgcatcattcccggcattgcgatcggcgtgccggtctacctgctggcgacgcgcctccaccagctcgatacctatcaggcgctgatcatcatcaatgtggccgtcaacattcccttcgcgatctggctgatgcgcagcttcttcatggaggtgcatccgacgctccgcgaggcggcgatttcggacggttgcagcgaatggcaggtcttcacaaagatcatgatgccgctggtgcttggcgggatgctggcgaccgccgtgttcgtgttcatcgcggtgtggaacgaatttctatttgctctcatcctgaccacctccgttagcccgacggcacctttggcgatgctcggctttagaacccagtacggcgtgcagtgggacgctgtcggtgctgcggcgttcctggtgtcgacgccggtcatcgccttcgccttcataatgcagcgctacctggtgcaaggcctgaccatgggctccgtcaagtgacaggcatggttggtacaattcttcgcagaaaggccgagcagaatatgactgatgtaactatccgcaatgtcaccaagcgctatggcgctctgaccgtcatccctcagctttcgttcaggatcgaggacggggagtttgtcgtgctggtcggaccgtctggctgcggcaagtccacgcttctgcgcatgctggcgggactggaggagatctccggcggcgacctcctgatgggagccgacgtaatcaatgatcgccccgccaaggagcgggacatggcgatcgtcttccagaactatgcgctatacccgcacatgacagtcgcggaaaacatgggctttgcgctgaaactgcgcaaacgcccgcgggccgagatcgatgaacgcgtcgacaaggcggcggcgatcctcgggctcggcaagttgctggatcgttatccgcgcgcgctttccggtggccagcgacagcgcgtcgccatgggccgtgcgatcgtgcgcgacccgcaggtcttcctgttcgacgagccgctgtccaatctcgatgccaagctaagggtgcagatgcgggccgagatcaaggcgcttcaccaaaggctgaagataactaccgtctacgtgacgcacgaccaaatagaagccatgaccatggctgacaagatcgtagtcatgaacgagggacgggtggagcagatgggcacgccgctcgaactttacgaccgcccggccaatatcttcgtcgctggctttatcggatcgccgtcgatgaacttcctgccggcgacggtcgctgcgacgaacggccctcttctgaagacgccggaaggcgtggcgctgccaatcgatggtggtccgacgcttaccggacgctcggaggtgacctatggcattcgtccggagcacctgcagctcggcgagaccggtattcctgcagaggtcgtggtcgtcgagccgacgggttccgaaacacagctctatgtcacggtcggagggcgcgaagtcgtcgctgtcctgagggaccgggtcgacgtgcggccgggcgaaaaaatctggctaacaccaaggaagggctgcgcccacctcttcgacccgaacaccggcgcacggatcgcgggctgattgcccgctcacgtcccgccgaccgcgtctggaagtcgaaacagcccgagggaggtctcatgcgcaagctccgagaactcggcgagcatggcgtcgttggcatgccgtgccgcgatcagtccgctgacgccgatcgcgacggcttcctgcgccatgccgaaactgtcgacgacggcgagcgtgctgaagcccttggcgatcgcggtccgcaagagattcatctcggcggtcacgccgtagccgaagtcctcgaggctggcgcgcatttctccgtcgatcgctgtcacgctcggaaagttgaccactctgtggcagccggcggtctcgagggctttgaggatgtcgacgtggcggcggaaaggatcaagggcgaacacgcccgcaaaaacctggctctcgctcaaaacgcccttccggagctcggacaagagacgttcgttggcgtcatggatcgggagcagcaccaggctgtcataggcgctgccacccaatccctcgcaggacgggcaacaaagcgtcacggattgtagatgatcgccgggaagggcggcgagatccgtcacgatcggaatggagggaagtgttgagggagagtgcattgtgtacccgagaaacgtttacccaattctacccaaatcggcggcctcagccaattgatttgctgtggcgcgccactaccgtttctttgaggcgaggaaagcccgctgaggaagggccgggaggagaaagatgaatacagtttatgtggtcgggacctgcgataccaagggcggcgaactgcgctatctccgcgatcttatccggcaagcagggtgtgacgctgtcctggtcgacgtttccgtctcggagttccacagccaagctgcggatgtcgacgttcagccgtcggaggtcgcgcgcttccatccgaacccgccgaagcccgaggatctcaaggaccgcggcaaggctgtcgccgccatggcgcaagccctggtggaatttatccggtcacgaccggacgtcgacggcatcattggtgccggcggtaccggcggtacggcgctgatcgctcctgccctgcgggcgctgccgatcggcaccccgaaggtgctcgtttccaccgtcgcctcaggcaatgtcgccccctatgtcgggccgaccgatatcagcatgatgtactcggtcacggacgtctccgggcttaaccgcatctctcgggtggtcctcgccaacgccgcccattccgtagccggcatggtcctcaacaaggttagcgccgccaaggacgagaggccggccatcggcctgacgatgttcggtgtcacgaccccttgcgtccaggcggtcacccgtgcgttggaggcagacttcgactgcttggtgtttcatgccaccggaaccggcggccagtccttcgagaagctcgccgattccgccctgcttgtcggcgggattgatgtctccacgacggaggtctgcgactatctggtcggcggcgtcttcccctgtacggccgatcgcttcggtgccttcgcccggaccagactgccctatgtcggctcctgcggtgcgctcgacatggtcaatttcggggcgatggacacagtgcccagccgatttcgctcgcgccgtctgcatgtccacaatccccaggtcacgctgatgcgcacgacccctgaggagtgcaacaggattggcgaatggatcgcggaacggctgaacctctgtgaggggacggtccgcttcctgatcccggagctcggtgtctcggcgatcgatgcgcccggtcagcccttccacgatcctgaagcagatagcgcgctcttcgcagcgctcgagcgcacccttcgccggacgaccaagcggcaactcatccgcgttccccttcacatcaatgatccgcaatttgcggaactccttgtcaccaacttcaaagaggcccttcgtgagcactgatactcttgtcaagcgtcccactcgttctgagttgatcgaccgtttccatagtaagatccgcgccggcgagccgatcatcggcggcggcgccggcacgggcctttcggccaagagcgaggaagccggcgatatcgatctgatcgtgatctacaattccggccgctatcggatggccggccgcggctcgctcgccgggcttctcgcctacggcaacgccaaccagatcgtcgtcgacatggcgagcgaggttctgccggtcgtcaagcacacgccggtgcttgccggtgtcaacggcacggatccgttcgtcgtcatgccgaccttcctgcgcgaactgaaggagattggctttgccggcgtgcagaacttcccgacggttggtcttatcgacgggcttttccgtcagaacctcgaagagaccggcatgagctatgcccaagaggtcgcgatgatcgctgaggcgcacaacctcgatctcctgacgacgccttacgtgttcggcccggatgatgccgtggcgatggcgaaggccggtgccgatattctcgtctgccatatggggctgacgaccggtggagcgattggcgcgcaatcaggcaaaacgatggaggactgcgtcgccctcatcaaccagtgcatcaaggcggcgcgggaaattcgcgacgacatcatcatcctttgccatggcggcccgattgccaatcctgaggacgcgcgcttcattctcggcgcctgccccggttgccacggtttctatggcgccagcagcatggagcggctgccgaccgaagaggcgatcaagtcgcagacgctcgccttcaaagcgatccgtcgcaagccggcctgaccgtgagaagggaaagcaagcagatgaccatctttcgaagtggagaccagccgccgggttggtgcgaactcaccgacttcgagttcgttgacttgaccgatcaacccttgccgattccgcttgccgccgaaaagcaacgtctgctcgtcacgagcggatcgtgctgcgtgaggagcgccgagggagcgcaggttctgagtgaaggccagttcctcgacatggatggggccaatggtcccttcaccgcggatgccggagaaggggccgcacaagtgctcgttttttatggcagatggggcaacgaactcggcggatgcggggtgttcaagctcggccccgacaccccggttccggtcaggggggatccggttaattatcccaagtcgacgaacttcgattcgcattatcacgactgcgacgaatactgggtaattatcgagggggcggggacggtcgtcgtcggctcacgcagcttcgaggttgaggtcggcgattgcgtcgccatcggcatggggcaccatcatgatctttccgaagtgtggtccgacgtgaagggcgcatatttcgagacgacgctcgaaggcaggaagcgctttggtcatctttgggagcacacgcatgggcctgccgatgtccgtcccgagcgggtttgatccgtcgcgtgcgccaagtcctgcctacctggaggtgaacatcaatgacgtataaggtcctgcatatcggcgccggcggtttcggagagcgttggtgcgacacgttcctgccgcagaacgtggcggacgggacgatcgaggtggtcggcctcgtggacatcgatgccaaagcgctcgatatcggccgcaagcatctcggcttgaaggccgaacagtgtttcaccgcggccgcacaagccttccagatggtggatgccgacttttgcaccatcgtcattccgccagctctgcacgaggggatcgtcgacctcgcccttgcgcgcggcatgcacatcctgtccgagaagccgatcgccgacaccatggaggcctccgtccgtatcgctgagaaagtgaggaagtccggcttaaacatgggcgtgacgatgagccaccggttcgatcaggacaagtcgacgctgagggcgctcgtcggtgccgacgccatcggccgtgtcaatacggtatcgtgtcggtttgccggagacttccgcctctatgattcctgggggcgctttcgccacgaaatgatgcatccgatgcttatcgagggcgctgtccatcacttggatatcatggccgatctcgccggcgcaccctgcacgtcgatctatgcccgcacgtggaagccggaatgggcagattacaaaggcgacacagatgccatagtcttgatggactttgcgaacggcgctcatggggtctatgaagggtcttcggcacaagccacgggtcttaacgattgggctttcgaatatgttcgggtggagggggaaagcggcacggctatcctcgaccatcgtgagatcgaggtatttcaccgttacccgatgcggcttcgacaagcgagccggcaaggaaaaggtcagcaagtgtcgctgctacccggcaggaagtggcagaatgccctgttgatcgagcaattttgtcaatggctcgacagcggcccgccgatggcaaccaacgtttgggaaaatctgcagtctgttgcgctcgtattctcagcgatcgaaagcgtccggctgggtcaaccggtgaaagtgcaggaattcctccagtcctaccgagtgggggcttcgatcgagtaacgataagatgtaggttagcctcacaatggctgatccgatcgttcatcctggggttcatcgtcccgaattctccgctcccctccacgcgagagcggagattatcgcgacactcagggccgcgcttggcaagccaaacacgactctcgttggtgctgcgatcggcacgggaatggccgcccaggcagcctcgcggggcggcgcagactttatccttgccctgaatgcgggacgtttgcgtagcatgggcgccccttctatcttttccctgctcgcattgcgcaagagcaacgactttgtcctggatttcgctcaatcagagattctgcctttcgttaaagttccagtctttttcggcgccagtgctttcgatccccggtgttcgatagaagctgaactggaaagaattgcggatgctggttttggcgcaattgtaaacttccccacctccatttttctcgatggacggtttcgagccgatatcgagggagcagggctggggttccagcgtgagcttgaaatgcttcgggccgctcagaaaagaaatatggcgactctcgcctatgttcgaactgtggccgaggctcagcaggccgcgaccgccggcgtggacatcataaatctcaatctcggctggaacgtcggagggactgtcggaagccgcacagagctcagcctgaggcaagcggctgagtatgcgaagatcattttccgtcagatacgggccatctcggaggatactctttgtgtcctcgagggcggccccatcgtcagccccgaccaaatgtacgaggtatccgcactgtccaaggcagacggatacatcggcggctccaccatcgatcgggtgcctctcgaagcctcgatggagcagattacatcggctttcaaatccgtcggcaccttgcaaaagcgaattgatgaactggagcgccagctcgagcatgtgcagcgcgaatactcgatcgttggtcggtcaccttcgatccagcaaatcaagcaacgtatcgaaaagcttgccgcttctagtctcccggtcatgattaccggacaagccggaaccggcaaaaaacttctggcacggggtattcatgaagctgccagacgttccggcagcaagctcatcagctcagaagacgcaagtggggaatcgctttttggcttcgccccgagcgagggcggcaggaaggtgcttgggctactccaataccatcccaaagcaaccctgctgatcgagagcgtcgaatgcctgtgcgtcgacgctcaggaacgtctgatagaagtcatcgagacaggcgcttatcggcgcctgggcgacaacgagagagggcggttcgaaggccgcctgatcctggcatcgacgcggccgcttcctgagttgggctcgagcgggcagctgatacctgctcttgagtcgcgtctcgcgccgggtcacgtctttcttccccctctatgcgatcgcctcgaagatcttccactcctagctgaacacttcctacaagcgctccgaaaggatcgtcgtagccggaagctgtcggtggaccactcggcctatcgagttctgatgacctatggctggccagaaaatattcgcgagctcagatccgtgctcgaaacggccgccatccgctgcgaaggcgactggatcaagtccgagcatctgccgccgctcggtgacgcgaacgcggacgcgccgcatccgcatccgggggaagagcgggaatggatcctggatgcgcttcagcgccatcggtttcgccgcggtgaagccgcccgatatctcgggatatctcgaaagaccctatacaacaaaatgcgagtgtacggtctcccgttgcagccaagagaaagatcctaggcgagggcgccaaataactccaggtagcttgttcagcgactgcagcgccgccgccgaacgaccgcagccggagcgcccagaccggttattggggtcgcgaggtagtggggcgcctaagctcaacacaagctcggacgtgcaggccttcactaaagcgaaaagaagcctctcgccgactttcacagaggggggagcgacagcactgttcgggggtaattgaagcggcggcggggaagtagcgaggtggcaacaccgtcagtcgctgtccggctttagcctcgcaagaagtgctaagacctcggcttgaatgtctaggcaaagggcttcgtatttgagtaccccttcctccaggtacggagtctctctccggtgacgttcaatagcctcggccgcgacggcgtaggcttcaaacaggccatccaattcaattcgcggctcctgatgtgccgcagcagatctctgtgacgaggcagggctagcgccagccgagctctgccgttgcgaaccagtgacatttcactcgatccccagcacggccctcggcagctcatccttgatcaggtacgagcaaattatgcggaggatcgcatttttatggtaaggtaacgctaaagcaggctaggtgttccgagtttgatggtgtggaacggccctccgagccgtggctcaacagcgatctcaaggtgtcagcgaaagcatctgcttttgactgtccaaaggaagtgctgcgcctctcaactcgccatctgactttaaatggatggcaggggtggccggtaacgggcatctggtatagacatggcgtcatgtcatgccagacgcagcttctcagcgcctcggaggccgccttaggagaggacttcctctccgctctctcgacggatctggacaattgggctctgttcctcgatatcgatggtactttgcttgacctggccgaaacgccggacgccgtagccgttccgccttcgctgcctgcaagtctcgatcacttgtcgaaaaaactcggcggcgctttggcactcgtgaccggtcgcggccttgattatgccgaccagcttttttcgccggccaattttcccattgcgggccttcatggtgccgagcgccgcgacccggatggccgtgtgcacaaagccgcagagacggcggattttgagcgactgaaggccgagctggtcgccgctactgccagctgggcgggcgttctgatcgaggacaagggggcggcggtcgctgcccattatcggcttgcgccggatagacaactcgaacttgaacagctgatggagtgggcgttgtatcgagccggaccagactgggcaatccagcacggcaagatggtcgtcgaaatccgtccagccagagccaacaagggcgatgcagttgcggcatttctcggccagccgccctttgccggcagacgcgcgatcgcgatcggcgacgatgtgaccgacgaagcgatgtttcgcacggtcaaccggctcggcggcctttcgatccgcatcggaccgcctgtgcctgcgagcgaagcgctcggctccatcccttctgccgaggccctgcgcggcatcatcgccgcattggccctcctgaatatttgagcacctgacatattttcttgcatgaaaggaattcggcatgagccgtctcgtcattgtttccaatcgcgtacctgttccggacaagggtggcattgcgccggccggtgggctggcggtcgcgctgaaagtcgccctcgaagagcagggcggcggcatatggatgggctggtcgggaaagtcgagtggcgaggacgagccggcgccgcttgcgcaactgcagcagggcaatattacctatgcactgacggatctgaccgataccgacgtagaggaatactaccacggcttcgccaaccgcgttctctggccgatttgccactaccgccttgatctcgccgaatacggtcgcaaggaaatggccgggtatttccgcgtcaaccgcttcttcgcccatcgcctggcgccgcttgtcaaacccgatgacgtcatttgggtgcacgactaccccttgattcctctcgccgcggaactgcgtcagatgggcctggagaaccgcatcggcttcttcctccacattccctggccgcctgcagacgtactcttcacgatgcccgttcacgaggagatcatgcgcggcctgtcgcactacgacgtcgtcggctttcagaccgatcatgaccttgagaacttcgccagctgcctcaggcgggaaggcatcggcgacgcacttggcggaggccgcttgagtgcctatggccgcatattcaaaggcggcgtctatgcaatcggcatcgagactgcggccttcgccgaattcgccaaaaaggcatcgaccaacagcacggtcaaaaaggcgcgtgaaagcatcgagcgccgcagcctcatcatcggtgtcgatcgcctcgattattccaagggactgacgcagcgcatcgaagcgtttgagcgcttcatcctggccaatccggcacagcgggggcgtgtcacctatctgcaaatcacgccaaagtcgcgctccgaagtgccggaatatgaagccatgcaacgcactgttgccgaacaggccggcagggtgaacggcgcgctcggcgccgtcgattgggtgcctatgcgctacatcaaccgctcggtgggccgccgcgttcttgcagggctttaccggcttggcaaagtcggcctcgtgacgccgcttcgagacggcaagaacctcgtcgcaaaggaatatgttgccgcgcaggatccggacgatccgggcgtgcttgttctttcgcgcttcgcgggcgctgcccgcgagctacagggagcacttcttgtcaatccctacgacatagagggcaccgccaacgccatggcgcgctcgctcagcatgccgctggaagagcggcaggaacgctggacgacgatgatggatcaattgctggaacacgacgtttcgcgctggtgccgggattttctcaatgatctgacggcatcatcagatcgatgtggttagggctccttcaatcaaagatcatcatcgtgccattaatgaagtccggcgaccggctgcggcgttatcgccatagccgcctggccgcatttggatcgtcggcacgggattgagattccaccggacccggtgtccaaacccgaaatcggctctcgctgcctccgaaccgcacccgaatacacggaattaccgtgcgcacctcgcacgcgatgcgactgttgtttcgagggtatcaaccgaatttcagactgaccgtcttgcgagcgccaggatctagggtcaggacctattaatttcgtttgggatgtgattcagagtctccattgaaggaggtcctgatgggtgatttgtttctgctaagcgagcgccaaatggctcgcatctctccgcattttccgctttctcatggggttgcgcgtgtcgatgatcagcgcgtcgtcagtggtatcgtctatgtgatccgcaatggtctgcagtggaaggatgcaccttcgcagtatgggccacataagacgctctacaaccgcttcattcgctggagcccggctcggtgtgtttgacaggattttcgccgctttcgccggcgaaggcccccaacctgagcgcatcatgatcgacgcaacacatctgaaggcccaccgcactgcggcaagccttctaaaaaaggggatgttccccgtcgtatcgggcgcaccaagggcggactgaactcgaagctccatgccgtctgcgacgaggacggccggccgatcatcatgttgctctctgaaggccagatgagcgaccacaagggcgcccggatcgtgctcaacgcgttgcctaaagccgattgcctcatcgccgataagggctacgacagcacctggttccgagaagagctcctcgcaaggggcatcgagccctgcatcccgtcctctaaaagccggaagaaaccgtacgtctacgacaaagacctctatcgtcgcagacacaaggtcgagaaccttttcgccaagctcaaggattggaggcgcatcgcaacacgctatgaccgatgtgcccacaccttcttctctgcaatctgcatcgcagcttctgtcatcttctggctgtgattaacgagtcctgaccctagctcaggtgccgtccgtttctttcccagacccaaagcgcgcgcaagctcggaacgcttttgagcatagcttgaagcaaccatggggtaatcagccgggagaccccatttctctcgatattgctgcggcgtgaggccgtacttagccatcaggtgtcgcttcagcgatttgaattttttaccgtcctccaggcatatgatgaagtctgcggtcactgacttcttgatcgggacggcgggccgctgttcttcgacggcagcctcctcagccttgtctgcctgagaggtgctgcatagcgagagatacgtctgctgaataagactggccagatcggcggcaggaacgatattgcggctcaggtaggccgagacaacccggcttgtcagctcaagattccgttgcccgctggctaaccgcggttggttcaatgttcttctcctgcatcttccgtcacttagatccgtccgcgcaatttgcagatatttcggtcagaaggaaggccgacagggagccggttgatttttgccgagagtttttctttttgacgcgttggtttcaccgagatcattctcgtcgcgtaagcaggccgctgctcggaacttgaaccacggccgagcaaacggccatccggtcgaaaaacccgcgtgactttagatacgcaaagttcgaggcgacgctcgctggtcgcattcggcttttggctgctctcgatgatcacgggcaccctcacagtcaccgagtgcctatccgcctcccagaaccatctgtgcggattccgaggcaagccgcccccgcattccgaaatcattccgccccccaattccgagaattagtcgccccctgattccgagatgatgccgccccctgaaaggggtcgtttgtcggggtgtcctgctggtgataccaacgagcggtgatcatgaccgatgcgcccattcgcggagtccgatggacatgatcttccacggctggtcgacgagcttgttccatgcggcgcagcaatgggtgacgatgtcgtcgtagtccttgaagatacggttggagagccagttgtcgcgcatgaactgccagacgttttcgactgggttgagttccggtgagcgcggcggcaggaacatcaaggtgatgttgtccggcaccttcagtttcggcgtcacgtgccatccggcctgatcgaggatgagcaccgcatgggcgccgtcatcgacgctccggccgatctcggcgaggtgctcctgcatggcctcggtatcgcaatagggcaggaccaggcccgcgccctttcccttccgcgggcagacggccccgaagatgtaggcccacatatgtggacggctcccgcttgcaagtgttttctgcagatatttttgaccggatcgcttgcttccatatgtgcggccttttggtgtggtcgcacatgaccactggccaagatgatttccgcaacgcgtattcctaacatggtctcgacctttagcggtcagtgggcctaacggagtttcacgcgtcttggatcgtccgatcgcatcatctgctcttcgcttgcaagttcacagcatcagctcacacggtagcattttgtctttgctcaccgtggtggctgaacttttatgatgtctgcgcttggccttctgcctggcgatatgactcgccgctcgtcataagcttccacgcaatccgcgccagcttgttggcgagcgctacggcaaccaactttggccttttccgctgcagcagccccataagccatgcagaggcgtgcctgctgcggcctgttctgacttgctgtagaagagatgtcgcgccaaccaccaagatgctccgcaacatttcgtcgccagcccgggtaatgacaccaagcctgacctttccggcagttgaatggtccttcggcgtcagaccgatccatgctgcaaagtcgcggcccgatttaaacattcgaggatccggtgtcttcatcaagagaagggaggcgcctatcgggccgacacccgggatctcggccaggcgtttgctgcattcatcagcacgatgcaacttcatcaacttttcatcgagcgttttgatctggcaagctagctcgcggtattcctgtccatgcagcgcgaagagatcctgcgccagttccggtagggacgggtcagcggcaatgcgctccaatagcgcttcgatgcggcacatgcctttggccgcaacgatgccaaattccatggcaaaaccgcgaatggcattggcgagctgtgtccgattgcggatgagtctctctcgcataccgaccagcattaacgccgcctgctgatcagccgttttcattggcacgaagcgcatggtcgggcggctcattgcctcacacaatgcttccgcatccgcggcatcgttcttgccccgtttcacatacggcttggccagttgcggtgctatcaactttacttcatggccgaacgaacttaacagccgtgcccagtgatgtgacccaccgcacgcttcaagtgcgataatggtcggcggtgttttctcgaagaacttcaccatttcccggcgcgacagcttcttacgaaggattggctgctcaaccgcattcacaccatgcaattggaagacgctctttgacgtatccataccaattcggataatctgttccacggacggtttccctcgattgagaacttcaacgaactcattctggcacattcgatgccgttgggagccgtccacctcaacatggtgcgctgatccaagggcgcggatggtctggtgccacgacgcgcccatcggcgcgtgatcttgttcttctggcctatgcgcgcttcgtcggcccaccagagttcgatgtccgtgccttgcgggagccggcttcggatttccgccagagcggcggggaagtctttttaaaagcgtctacttccagctcgttctgagcgtagtggcgtgggcgagccgacagcttggcaaagccgagcgccttcaactcgcggccgaccgtcgtctcgtccatcgagatgcggaattcctggaatatccactgaaccaggtccttgcgccgccaacggacaacaccgtggatcgccgggatcgggccgctctcgacgacctttgcaagagcctggcgctgagcggcattcaacttcgctcggccgccaggcgctttgccattcaccagtccatcggggccgcgcgcgttgaaacgcaggacccaatcccgcacaatctgcagcgtcacgctgccgatccgtgccgcatccgagcgcgggccgccgtcatagatcgcggcaagagccagcaaccgccgggcctgattggcatccttcgtctgccgtgcgagctgtcgaagagcagctccgtcgaaatcatcacgcaacaaaaccgccgaacccatcgcaaacctcctgtttgcagcatggattcagattcgcgacaccttgggaatcccatgagagtcagaaacggcgctcgttggtatgagacgttcctcctttcagtgtcagaggggaaggaacgggatgccagcggagagactaaagatgcggcgtgtccgcgaggttctgagatacagatttgaggaaggccttggccacaagtcgattgcggtgcgcgttggagcggccccctcgaccgtgcgcgagacgttgcgccgtttggagcgtgccggcctttcctggccgttgggcgacgatgtcagcgatgcggtgttggaagcggctctctataaagctgccggcacgaagaccggtcatcgtcgcagcgttgaaccggattgagcgcatgttcatcgcgagctgaaacgcaagcatgtgacgctgcagatcctctgggacgagtatatcggccttcatcccgatggatatcgctacagccgctactgcgatttgtatcgcgcctgggcactgaagctgccggtgacgatgcgccaggaccatgcggctggcgaaaagctgttcgtcgactatgccggcgacacggtcacagtggtcatcgacagattgtcgggaaagacgcggcaagcgcacctgttcgtggcagtgctcggggcatcgaggctgtcattcgcccatgctcgctggagtgaaacacttcccgactggattgaatgccacctgctggcgcttgaggcctttggtggtgcgccggcgctgctggttcccgataacgccaaggtcgccgtcatcaaggcctgccattttgatccgcaggtcaatcgcacctatgccggcatggcagcgcattacggaagcgctgttcttccgacgcgaccgcgccggccgcgcgacaaggagcggacatcacgatgcaccttgttggagtggttgagcgacaattaatctgggttgacggccaccatatcgactgccggcgcctttttcgagtctgacgttgcccggcggttcgtacaagtatcgatggttgctggcgtatcgatgacgcttgagagtgcctttgcgcccgagttggtgaacggtcgattcgcatacgccgagctgctgggctacttcctcgccggtgagcatgccgccctcgcgcagccgttcgtaccggctcttcaaaccataggtgcggcgcacgagcatgaccttcttcggcgtgaagggttcgccgcgccagttgcgatgcccgagttcgttgagacgagcggcgatctgccggtcgttggtggcctccagcagctcgttgatcaacgccacgacctgtgccggcgtcttgcgtatcaccgacataggccgaggtctggccaccgacaggctctgcgtgcgcccgccgcgccaacggatgttgatgttgacctcatcgtcgacgagcagcgtcacgtcttcgatgagaaggccgagcatgcgcttgcgttcgacggcaccggtgcgctcgtcgttccagatgcgcgggaaatcggcggtcagcgccctgatgcgctgctgcgctggctcgtccagcagcgagtggtcggcctcgttctggcgctcgtgctcgcgctggagtgcgtcgaggtcgcgcagccgtgcgttccagtcggcttccagcgcgtcggcgaccaggcggttgtccggatcgaccttcaggtagcgccggcgggccagttcagcctcatagcgggcgcgttgcagctgcgtgccgcgcagcgccgcggcctgctccacgcgctgggtgatctcctgctgcacggcaagcgcgacatcgatcgctgccggcgccattacctccagcagtagcgcgctcaccgcctcgtcgaccggagcaccgcgcacccattggcagtgtttgccggcgtgtcgcacgacggcttcgttgcagacgtaatatgggcgcagccgcccctcgaacggctcgtaatggacccgcatgcgtgcaccgcagcggccgcacagcagccgtccctgcaacaggccgctgccctggcggggcatgcgtccacgcaggccgggtgaaaaaccggtggcgttctgttccagggctgcctgattgcgttcgtattcggcccaggaaatgtagccgtcgtgggcgtcgggaatcagtacctgccagtcggatctcgccacgcgcagttgcacgggcttcagcttggcattgtaggcggtgcgcgtgcgtccataggcgaaggcgccggcatagcgcgggttgtgcaagatctggagcacgcgggaatggtcgatctcgttccacaggacgtcgcccttgccgatgccgcgacggatacgccgcggaaagaggatcttctcgccccgcaggcggcgcacgacggcgcaggccgagccggtctggcggaaagtatcgaacaggagccgcaccgtgtcctggatctgtcggtcgggatcgagcacgacccgcgcgtcaggggtgtagaccaacccgatcggcagcggcatctcgagttcgccgcggcgcgccttgttgagaatgccgccttgcagccgcgacttcaggatgtgcagttcggcctcgctcatcgtgcccttcaggccgagcagcatgcggtcgttgaaataggccggatcatagacgccgtcctcgtccatgatgagcgtgcgcgacaaggcggccagctcaaggagacggtgccagtcggcattgttgcgtgccaggcgcgacacttccagccccagcacgatccctgcatgtcccatcgccacttcgctcaccaggtgctggaagccgtcgcggtcctgcgactgcgcgccggagaggccgaggtcgctatcgatgacgtggacacgttcgatcggccagcccagcgccacggcgcgatcgcgcagggcgtattgccgcttggtgctctcggtgttctcgaacacctgacgaagcgaggactgacgcacgtagaggaatgcatcacgccgcagatggtcggcgtcaacctttatggcgatgtcagtagacatggttccctcgggtctctgctgccagcaccatgttggcgagcatgtgcacgagctggcgatcgtgcactgcgaccgaagccgtaggccgtgattccagccgccgatgcgtcggcgggggaggctgcgcgatcagcaccgccagcccttgccaaaggccgtggaaaacgatggcgcccatgtccttggcgcaggcctgaccgcaaaggacggcggtgcgcagcgtctcgtagaaatccttgcagctgcgcggtagcaccggggtgcgtgcatggggctcaccgtttttttttacgggcgatcgcgcgttcgatgctgcggggatggacactgatgccgagcgtcgaatgcagcagttctgccagggagcgcgcctgcagcggggcgcccgcatgctggttctgctcgatgagctgcatgacctcgtcggtgagtttgtgggccgactttggccctcgggtgcgcggcagcaggccggcaatgccgtcgcgttcgaacgcggcctcggcctgatagtaggttggccgcgacagaccgaaaagcgcggcggcatcggccttgttgacgccatcctcctggacgtgacgcagcatctcgtacttcacctgcacgagatcgagaggatcgaagaaggtggactcacgaaaccagggtgcacggacggcttcgggccgcgcattgagtgctccgagctcgcgcagtcgctcacgtttggtctcgttgggcatggcataacctcttcctagtggtgtaaatcaaattacgcctcgatagagaacgtgtcaacctaacgacgccgggcgatatggctgtttatgctgcatataactacaatgtagaggcaattatcgctgtgagcgcccgtatgattcggcataattagatttacataatcggcataaattgcctgacacgcattcagccgccatggctgcgctcgatttgctcgatcaatgcggctagggttgccagatcatctggacgcacgaacgacctaccggccgcgatctgaatgaaaacatcgggtgcagcgacgtccgtccatgacgcaagcagcgagcgaagccgcccatccgcgtcgtagaacatgacgcgatcctcgccccagttctgcttgcgtgtcgacaacacgaagcgctggccgcgccacggatggaacgggtgcgtgacctcgaactctatacgcacttgagtgtcagtacgaactgcagtcctggacttgaaagaaggcaaaagtcgaagccgcggttcgcattgtcgagcgctggctacttggccgattgcgccaccgcgtcttttacagccttgccgacgtcaatgcggcgattggcgaattgctcgtcgatctcaacgacacccgtgttctgcgccgtgtcgggcgcacgcgacgccagttgtttgaagagatcgaccatcctgctctccggccgctgccctccgaacgctacgtctttgccgaatggcgcatacgccgggccggcctcgattatcatgtcgatatcgacaaacattactactccgtgccctaccgatttgcccgcgagcaggtcgaggcgcgcatcaccgccaataccatcgagatcttccacaaaggtgagcgcatcgctgcccaccgccgctcgagtggcaatgggaagcacacgacaacacccgaacacatgccatcatcgcatcgccgctttgccgactggacgatagagcgcattagccgcgaggcatcggcaatcggatcggatgttgccttgctctgcgagcgtattctcgctgatcggccgcatccggaacagggcttccgggcctgcctgggcattatccgcctcgtcaaagccttcgagcgcgagagggtcaatgcggcctgcggccgggcattggaaatcggcgcgcgaacctatggatcggtgcgctccattctcgacaacaatctcgatcggtcgccagcgtcagccggcacagcctcgcctgaacccatccaccactccaacatccgcggtccacgctattaccactgaggagaagccatatgcttgcacatcccactcttgataaattgaacaccatgggcctgaccggcatggccaaggcgttcagtgaactgatcagcaacggcgaaagcgagcaactctcccatgccgaatggctcgggctgctgctcgagcgagaatggagctggcgctacgatcgcaagcttgccgcacgtctcaggttcgccaagctgcgccaccaggccgtgccggaggatgtcgattatagaagtgaacgcggtctcgatcgcgccctgttcatgaagctgatcggcggcgactggatcgatgcccacgacaatcttgccatttgcgggccgtccggcgtcggcaaaagttggttggcctgcgcactcgggcacaaagcgtgtcgtgatgatcgctcggttctctaccagcgcgttccgcggctgtttgccaaccttgctctggctcgcggcgatggccgttatgcaaggctgcagcgaaccctcgggcacgtgcagctcctgatcctcgatgactggggcctggagccgctcaacgagcaggcgcgccacgatcttctggagatcctcgaagatcgttacggacgccgctcgacgatcattaccagccagcttccggtatcagcctggcacgagatcatcggcaatccaacctatgccgatgccatcctcgaccgcctcgttcacaatgcccaccgcatcgacctatccggcgaaagcttacggcgaaaccagcgccggaaatcttgactcgcgaccacgatcaactgacaacaatgacagccagcaggaccccagcctcaagggggcgagatcatcccggaatccgggggcgcaatcatctcggaacaaaggggcggcttcatcggaatcggcaccatctgatagaaaagacgccgaggcggcgtgaaacgcgaggcaagaggtaaccccgagatggcataggctgtcttcgtcaaatattcgattgcaacttccccggttgcctcctaattaagccgccagacgcctgtgccatcggccgttggattatattgttcttttccagatttagcgggttacagcttttgtccacagaccagaaccatttgattttcttcatggatgatttcggaacacgtacggcttgcaaggcgaccgaaactttgcccatgtggtcgcatgtattcagcttcggcttgggtggaatcatcgttccatcggaggccgttcacgaaatctccagcgcgaccaatgacctttgcgcaagatgggatgtgcccgtgctgcacggaaacaagatcagaggggcgcgagggagctttggtttcctgaagaaagacgagaacaagaaagcgcggttctttcaagagctggaagaaatcctgatcgacgaccggattaccgcccatgcttgtgtcatctgtcggccaggctacagagaccgctaccatgacaagcgccctgagggtgtccgttgggagatgagccggaccgcattcgatatatccgtcgaaagggctgccaaatatgcccgttctctcaagcgtaagctttcggtggtctatgaacgaacaggagaaaccgaggatcgattgattgaaggttacttccagagattgcggacaaccgggacagagttcagcgttgaaaactccgctcaacacagtcccatgtcatctgccgatttggctgacacattgatgtcgatctggccagacggcaagggaaacccgatgctgcaattggcagacttggtggtccatccattggggcatcgcccaacgggtcttaggaatagagcatatgaccgcttcgcagagtcaggccaacttctagactctcgcaccgatgatccgacgatctcgattaagtattcgtgctacgacgatccgtacaaggaatacgtggctcctgaaggaaaccccagaaacacataagggacccgaaggtcccttatggcggttagcgtaaaagcaataaccccgtggcaaagccataccataaggtagataagtcctgtgccatttgcaaggcgtttgtgaattttagccaaaaatcgctatctccttgaattgtggttttaaagactcttgaacggcttcacaggccgacggtaagaagcgcgtgttgtcgatggctttcgccctgaggcgttctccacgcgcggtgcgcctcaagacagtccctgccgttcgaaaaaatgaaagcgggcggccgttcgatatccggctatcgttctaccgtccgcaggcactttggtttccaaccagtgcctttcgcgcccgacaacgtcgccggagggcatactgatcagggcattaggcgcaggtagtatggtgattcgctcggtgggccgaagtggccaaaaacctgcgcgattgttgcctgcgtatgctcgtgaaacaggttcagcgacgccgagagcagcgtcgaggatggcgcagctcagggctaccagcttcgaccaccgtaaggcaagctaatattaggtggattgctgcgcggtcgcattgaaccagggttagacaattgaatgcaatcggttcccggtattggctaaggtagattctgattggcttcgccaggttgacgcccgttgcgcggtcgccagccgcatcagcgcaaactgacgcaagggcactgggcaaatccccatctgacctcggtatagtcgatgttgacgttgacgtattgcgtcgaggggcaagaggatttcagctcaaggaagtgctctttgaactcgatctgccgcagaacgattgctccgtattcgtaatatccgcctgccccattttcgagaaggtaactttggtaggtgcatgtcagtgccttgtattgcggcggcttgccattgccgctgaaggtgaggttgcccatctcggtgaggaagatctggaaatccatcagcagcgatgcgccatctgtgatgattgcgttggcaagcaaggagagaaaggtggctgcgacagaggtgccggcaaacctgttgcaaaactcttctgcttgtgtctgccgatcgaaacgtcggggatgttggcaacaacgtctgtccaggtgttgatgtccagtttttgtgaatcgatgatggaataatgggtgtgcgcgtagtcgtgaatgagtcctcctatcgccagcaggttgtcctggttctcattcataatgccgttatagatcggatcgttcgttttctggccgatgaggtgaaactgtactgccccttgatcgttcgcgatcgtgtcgtcactggggggcgcagcatttctctgggccaaaaccaggggcttgcggcagaaaagcgctctcgccgcctcgtagttcttgtctgaatagccctgtttatgctcgtgagtatccactgcaattgcgttcgacatgcttttcctcgtggggagatctgagcgttactgtaagatccgtgaggtgccctgaacgcgcaaagcctgagtgcgagaacattttgggcgtctgttgatgtataccaggtcattccggtctccacctttgcgtcaggcaggcttttctctgcccgcgaccatttttgcgatagcgtagcggcgagaggccatgaaacgccctgaaagctgtcgagaagttgttgctgttgtcgtaccctagtgactctgcgacggcggcgacgctttcgtggccgcttcgcaggcgcgcggcagccatggtcatccggtagtgccgtaaccaagtcatggggcgcagttaaaggatgcagcaaagcgcttattggtgccgatgatgcgagccaatttgctgagggtgatcttctggtcgacctgctgtgcaagcaggtcgcatgagtcctgcaccatgggatcagctgagaagaatggcggagcagaacgccgagcgatctcggcggcgcaggcggtaagtctgctcagaacttcctgctcgataggcggtcacagcagttagtcaaagtacccgttggagtaaactgcccttcgatacaggctgccttccgcaaccaaggctagttgcacgagttcggatgagagctccgtacgatcgtgattgttttgcggggcgcgacaatccacgatgacgagttccgccgagcgtcctggccgcaacaaacggtaatcaacgatatcgaccttcggcagagagctcgcgatttgggccaacgacgtacatgtgaccaggtcggacccaaggtacgctcccagaatggatgcatgcacctttggcccaccctgaggatatggcctaccaattggcttggtgcggcgcacggcagttgacgaggggagacttggattgtgtagatggccgaacgtgtgaatacgcgctcgtttggcagtttgccgaaaaccctcgattcaaattccggctcgcgataggctcgcatcgagctcgttgtattggcgcagcggcgtcttcgccggccggcgcatgaggagagggtaaccaaccgtcgccgatatggaccgaaggcggccagatttcggactcattgcctggacgcagcatcggtcgactgcccttgctctgttgccgttgccgcggcggcgatctcctggcgcaaccaccgatggtccgggtcgcgatggcaacgctcgtgccagatcagcgcgacctcgtagggcggcagttccacaggcgggtcgacaatcactagcggcagcaaggcggcgttcctggtcgcgacgcggcgtggtacgaccagcaccagatcggtcgacacgatcgccaatccggccgtcaggacattggaaaccagcaccggatcgggatcctggagatccaacttgaccagatcatcatgcacccggccgaaaccgtctttggtatccgaggcaatggcggcgtggcgcagggctgagaaggtgtcgattatcgattcctgctccagggctgggtggccgttgcgtagcaggcaagcaaagcggtcgttgtagagcctgcgccgaaagtagcccggtggagcctcaccgatctggccaacggctaaatcaatttcgccttgctcaaggcgtcggagcgctaggagcgaatcggtcactatgtccaggttaggcgcgcgctcgcgcatcagcggcaggaaaggcggtagcagcacgatcgcttgatgatcaggcattgccattcttgccgttaatcgccattctccctgatcaaggccggggtccaccatcccgcggatcgaatccaacaccggcggtagcatctggcccaggcgttgggcgtgaggcgtcggaaccatgccgcttgagccgcgaaccaacagatcatcattgaaaacgccacgcagcctgatcaaggcccggcttaccgacggttggctcaggcccaggtgccgggctgcctgcgtcacgttgcggtgctcgagcagcgcctcgagagccaacagcgtgttcaggtcaagcgatgccaacatttgccgtcgccgtgcggcgcgagggccggcgacgatcagttgcggccgctgccattcgttcgaggtgccattacaagcgggctcatccacgagcctctccttctgtcttcgtacgcagtgtgctcaggctaacgtctcggagaactggcggtgcggagtagcccgagcatgctgagcacatcaggggtttctccagccggatcgacatcgtcaaaacacggcgtcgattagagaggtgataactggtcaaacgctcgacccttcagtgccggcgacgagcgcatttctgacgtttggccggttaccgctcgacgctgttggaggcgatctcttcgggccggcgactgagccggcgcatttgagaatgcggagaggatcgcctcaacgagcttgattatctggcgcaacccgtgagttctccccgcggtctgcgccatcgccttacttcgtcagccgggaaactggtctgtcttcgccttcgtgctgtgaccgcgacacattcaccatacttccgcaagacagattgctggctgatttattttacccagtcgcggtcagcctgcaactggcgcggccgcgtccaacggcgccgccaaacctcggggtggatccaggcttgcgaggaagtcgtggcaccagcgatagacatcgtgctcacgaagcctctccatcatcgcggtccatcgtctaatccgctcatctcgcggcatgtccacggccgtttctatggcgcttgccatgtcctccgggtcatagggattgacgaggatcgctccttccaactcactggaggcaccggcaaagcgcgagagcacgagaacgcccgggtcccggggatcctgcgcagcgacatattccttcgccaccaggttcatgccgtcgcgaagtggcgtcacaagaccgacgcgtgccctgcggtagacgcgcgccagttccgcttggctgagcgactgattgatgtagtgcaccggcacccacccaatggttccgagttccccatcgacgcgccccaccagctcggcgacgtccttttgcaccgtctgatatgccggtattttgtcgcgggatttcggggtgatctgcagcagcactgtcttgcgcctgcgatgtttgttgcgctgtaggaatcgattgaaggcgtcgatgcggttctcgatgcccttggaataatcaagacgatcgacgccgatggcgacgtcaaatccagcaagcctgcaaaagcgatcctgcagatcgtcgtcgcggtctgcgagacatgcgaactcggccgtatcgatgctgattggaaatacgccgcagcgaaattcttttccataggctcggcagtcatctccgttgagatcccccactttctgccggagcaggcatttggcgaagttgtagcgatcgttttcggtatgaaagccgacgaggtcataacacgaaagcccgcgcagcaggttatcatagctcggcagggtgaagaggatgtcggccggcggccacggagtgtgcaggaaaaagccgatccggtttttgtggccacgctgttgcaatttctcagcaagcgggatcaggtgatagtcttgcacgggactgtcaggaattctgtgcggggggccatgatgatgaaaaggagcgaatcatcacatggctatcgaaaaagaacttctggaccagcttctcgccggtcgtgatccatccgaggttttcggcaaggacgggttgctggacgatctgaagaaagcgctctcggagcgcatcttaaatgcggagctcgacgagcatcttgacgtcgagcgtagcgagggaacagccgccaaccgccgcaatggctcttcgaagaagacggttttgactgggacgtcgaaaatgacgctcaccatcccgcgcgatcgggccggcacgttcgacccgaaactgatcgcgagatatcagcgccgctttcccgatttcgacgacaagatcatttccatgtatgcccgcggcatgacggtgcgcgagatccagggccatctcgaagacatctacggcatcgacgtgtcgccggacctgatttcggcggtgacagaccaggttctggaagccgttggggaatggcagaataggccgctcgagctttgctatccactcgtgttcttcgatgccatccgggtcaagatccgggacgaaggtttcgttcgcaacaaggcggtctatgttgcgctcgccgttctggcggacggtaccaaggaaatcctcgggctctggatcgagcagacggaaggggcaaagttctggcttcgggtgatgaacgaactgaagagccgcggctgccaggacatcctgatcgccgtggtcgacggcctgaagggtttccccgatgccatcaccgccgtctttccccaaacgatcgtgcagacctgcattgtccatctgatccggcattccctggaattcgtgtcctacaaggatagaaagcccgtcgtgccggcgttgagagccatttaccgtgctcgggatgcggaggccggcctgaaggcgctggaggccttcgaggagggttattggggtcagaaataccctgccatctctcagagctggcggcgcaattgggaacacgtcgttcccttcttcgctttcccggaaggcgtccgccgcatcatttataccacgaacgccatagaggccttgaactcgaagcttcgccgagctgtgcgctcgcgcggccatttccctggtgacgaagccgcgatgaagctgttatatctggttctcaataacgccgccgagcaatggaagcgcgcgccgcgggaatgggttgaggcaaagacacagtttgccgttatcttcggcgaacggttcttcaactgatcaaaccggccccccgcacagaattcctgacagtcccgtcttgcacccatatgacgtcgtcctcccggagggcctgctccaacagatctgcgaaaagttcgttgacgcggtaatatgcggactcccgcgtctcggaatattcagcgaggtcggcacggttgtggaagatcggccaaagaacctggttggcgaagccatagtagaattcttccagatccgtctgcgagagatcggtaagcgcgtaagtgatgccgccgacgtcctttctgatcaacgctgacggttcttcctcggctgcgaccttgcccgaccatcccatccagacaccgccctttcgccggagtgcggcgttcaatgcaaccgccatccccccggccgacgacgagccgggcagggtaaccctgttagacacgacgatcagtctactcatttcgacctcccgtcgtcgcacacgccggcctatccatgcgaacgcggctctccagttgttcagaagttgctggccagggtagctcattctgcgcgaccacggcagccatgtgcgtaagcatatacacatcagtatctcgtattgagagaagatgttttgatgatggtaacaatagcttcattagtagacttttcagatgtaggttagttggcatgtcaactaataatagtactgatagtttgcatagtaaggctcgcaaaatgcacggctccgtcaacttttcccaggtttcaagtgaaataaagctgagccggattagtatgtttcaaaaaacagcaatcaagcgtgcacagatgccaacgatggggctaaaggagcggaggcaaacgagactcgtaggaagagggtctcccacaatgttggtgtaccgcaccagcaatactctacgttaaatcagcagaacgcgaccgccgaagaccagcggccttcgagagctcagttcccgcgcaacagcagaacgctccgcatagccctatttgtctgcgctattctgctatgcacctgatgatgattgccccactcggtggccgtcctcattttgggagtgatggcccaggaggccaaagctacagcaggagtgactatgaaaaacattctcgttatcagtcaggacgcttcgatgaggtaactgctgatggagttcttgccaaagcatgcgtttagcgtcagagcggtggaaaacggccagcaggccggtagcaagatggcttccgaggtgattgatctagcaattattgatatgagcctccgccgagaagatggtcattggctcgtcggggattttggcgcaaagatagaccttccaatcatcatcatcagcggtgacgaccttgaagagggtgacaacatcagccgactccacaccggcgccctcgactgtatctccaagcccttcggcttgccggagctcctgacccgcgtgagcgccgctttacgcgatcggccagagcgtcatcggaacaggatcttccatttcgatgactggcgcgtcagcacgaagcgtcgccgtttgcgccgagggaccaatggtgaagtcaagctcactgcgggcgaattcaacctcctgatggcctttctcaacaatccgggcaggtcctttcgcgcgagcagcttttggtggcgacgcacgtctatgatcaagaggtctttgaccgcagcatcgatgttaaaatcctgcgccttcgccgcaagctaggtcagcacaccggctcgaacccgcaatatattcgcacggaaaggggcgcaggctatgttttcgacagcgtcgtgaacgttgacgagttgaggacgcgcggccactgacagcgcactcattctattttgcttgaaggtcgcatgttcgcctcagggcggttggggcgctggatttccatcaaatcctctcgtcagatgaacgagagctactccaaccaagtgtctcttctgggtgttgcagtggcgctccgtgtcttaacgacggaccagaatgccccggtttaaaaggctccaagcggcggtccggcgctggagctctcgacgttgccggccgtcaagaccgtaaagccggcggactgccaggcgacttcattaaaagtcgcttgtagagacccacagtccatgttgagaaggggagatattcgccggccgcacgctcaattgtcctcgcggcgacgaccggcgaatgtgcaagagaattcgattgcgcatgacgccggtcccgaggctgtcgaagcgaagctgaagacacgttggcactcccgtccgataatccaacgcaagcgtttagcacacctgagccggcgtcaacgacgccggagcgagcttgctgcaccacgccattcgccgggggctgaatgcttgcataagtgagtggcggcagggcgaaagctgcgcgaggaattcacgagattgagtggcaagctgctgtcggtcgtgcgcgacgatcagtttgccggcggatgggctgggcctcgatgatggcgcagatgcagaacattatcgacttcccgcccgcgcccaagctggacgcgtctggacgccaagccgggcgagcgagcagcagcgagagggcgaacgggtgtttatgagagtccgctgcaccgttcgccacgcccccgcagaccgccttcatgtgcaacaacatgcacgacccgaagctcgggcgcttctctaatatcagcccgacggccaacgatctcgtgatgttaccaggtggtccaaccaaaaccttcacaccgcgacgctgcgtggcatcaaggacgctccaccctacttgcacgatgggcggctgataacactcgccgacacggtagagttcagctaggtcttgtaggtggagatcgtggccgcggtggtttccaccctttcgaagagaagcgcccgacgtgttaattgtccgatccaggcatgaggcagccagttctcgggtccgccacataggaggatcatgactggtctgggcgctcgcgcttctggagagcggatgatcgttctgaggcagcgacggtcggtccagcttggttcgccgctctgagcgttcggatgcgtgtgccagtcgccaatgtaggtgtctacacggcctgacacgcgataatgacggtcgatctcggattgctcccattcacggtccggggaaaagcttttgcgtgtgcggatcgcttccgatccgccgtcaatcatcttcgtgattaccgcgacattcgcgtccgaccagtatcccataaaggtcccgcctgtttcgaggtcgtgccaacggctcgcgtctttcagcatcgcttcgacgacggactccggtatccaaatcagcttcggcatccgcagtccgggtgtcgttccagtggatcgatccgccaactcggcggcatacgacgttttacgttatgcagattgactgtgcggacctcggataccgtccactcatccgggctagacaggacatcgacggccatccggacggtctccaaggacagttccttcaggtcgaatgaagctccggtgaaggtgagctcggagcaaccgggtggctgaacgagcgttgattcgtcattcatgccgttcggataggggatgtgccccgactttccttccggggtctcgttggcgtgcgccatgcacaccggacaaccggattccggatgatggaatacgaccgccccgccatgcaggttgggtgaggcgaaaacggagatgagcgaaaggccacgctcccggcagatgtcgccgagaaggtaggtaacgcccggcgcggcactggcgtccacaacgagatcgacgctgtctaataactcgttcagccgatctgtttctccgggaatgtgcggatcgcagtttggtaatccaatgcggtgcgggacggccagaacggacgtccatggaaattcccgttcgatgaaccgcttcaaggcgtcctgcttcttcgttccccaactactggctccaagttcccaacggatcgtgttgcccggttcgacgacgtcgtcgtccatcaggtggagcgaggtgcagccgtttctagccagttcgacggcagcgggtgatcccagcgccccgagcccgacaaccgcaatgcgtttgcctctcagactcgcgaccgatggaactcgatagccgatgtctatctcgccgtcccgaaaaacaggcacgatggacgggaccgtgtctttacgtcgtggtcccctacgacttgagtgtgaaatgtgctctcttaccgccattccgcacacccaagcatctccatgctcgttgtgttgaagttcggtcctgctgatcgtgaatgagagccggatatctgctccgtcgcatgtcacatatgttttcccgtacgcgactttgccgaccgtctgttcagcagaacctgttggtagggaaagttggtcgtcccgccgccaagggaaggcgcgaatggcagtcgaagaaacggcggcaggaagaggcgcaacacgctcccccaaaagactaccgtcaccggccctgacgcttaagatcgcagccctgatggtccggccgatttctgtccggcttgcgttcacgaggacatcgacagtcccttcgtcatagccggagagcttccatctggagtcaacgaggacgaagcttccgctcgcttggccgaggctgttccaccaatactcgatcggctctccttgtggatcctccgctcccgtgccgtccaggacatgcgcgaggttttcgtcgaggagttccgccaatgacatgttggcctgccaatagcgggtatcgcgccccagcagacaaagagctccttcggatccacagtgccgctcaggatattcggatgggtcgcaggtcagaaaaacatgggggcgcaggcgtggaaaggtatctggataaactgcccgcagcccaatcgttcttccgtcgttcaatggccatgaaaactcgattcgaaggattccggcagccgccgcctcttcatctacgaggaggctctctccagcagcagaatgaagcttttgaagttccgccagcctcctgcgccctgctggtgtgacagcaagagcaggaggtggctcaaagtcggtgtatggcttcatgttcaaccaacgtgcttcggaggcactttgggtggaacgcttggacccggatgattcggcggaccaggcggatgaccgggatgaccaggatgatcgggattgccgggctcgcgtcccggattgtcagctttgcctgccatctgaggctccttctttctgcggtcggtgctaagttttagtgttgttcgactaggcgtcttcaggcacggtgaacggcttaagaagcgtatacctggttggtattccatgcgaagaacttattggtgtatccgtagtcggccgattcgtcgaaaattgcgtcattcatgtcgagcgtccgtttcagcttggtagctgtgagcccaggactgtgttgcggccccttttcgctgatgtctttgatattgatggtcacggcttgtcctcaattgacttactaattgggccgaggaccttgacgagccagcctctcaatatggagcgactatacgaccgcgcctaagtcagatttcaccatttatagggtggaagacgcaggatatcagcaacttttcagctggcccgcagggttgctgcaagtaagtgcgatggccccaaaaggtgacgcgatccagtcggcggaaaggaccagggcgttagtactgcttgccgcgacttgaaggcgcagcccgtcggaggaggagctcgcatttttcggtcgggttcacgccgacgcgatgccgcgtccggcgctgtcggaagcaatgcgtgtctccttccttgggacggcgccgttgccgaactcggcaaagatggcagcgatgaacgacgcttctggaaatacaggacgacgcccgcagatacatttgagctgcgcgtgggcgtcgctgcagccgagcaagctgcgaggccgcgaccttcacgtacaacgctgttgtgttgatgctgcgatgtacgagaagatcggcgacctcgttgatcggccttcggatgtgagaagttgctgccgaacgggtaccggaggtcacgatagcgacacccgatgctcgacagcatcaaggacctgctcagccgtcaacgcctcgaggttttggtagggatggtgatggcggaaccaatccagaaagcgtcggccgcgcagaagaacgccttcgcgggtgttcggctccagccccgtaccctatgcagataatccaaaaaggaggccagaagcggagcatccgggtcaacctcttcacttgcaacggggagccacccgccgtgcgtgccccagcgccgacacggccccaatgcgcggaggatccgtactaaacgcgcccaaatagcgttgacgacatggatcggcatcgaccgcagtgcgtctcggcaaaccggctaaagcgcgcaattcggctcaggtaaatcttgccgacgctcgcttgtaaccaagcgtgaaaaaatattccgcgaggcgatccatctcgccgcggagcgcaccactactagccgcttgagcaccccaccatacgaaaaatatgactcgagcataccgcccctccggcatagcggcgcagggggatcccgcgcctacctcagaggaaccaatcttatttcgaccaccgcgtccgccgcacaccgcaccggtgtttcgcagctcgaatgccggtatggagcaggtcggccgcgccgagcgtcacaacgccgtggtcgcttaacttcccacaaaaccctcgtgctctccaggcatcatacagtttctcctgggtatcgccctcccatgttgccgctgatgcaccagatagttggccgcgagagcccgcggctcggcccagacctgacatcctgctgtccctcctacgctcattcggtttgcagcaccacgtggaacctgccgcctcgtgccatgaggagtcttgaaaaggcgccctgttcacaaggaagcgcctcggcaggttttggtcagtgcccatgcgtgcgttcagccgtaggtagttaatcggaactggacctgaacgcgtaattggccgctgctagatcaactgcatcgttcaccgttctcacacgttgaggttcagcacacatgaggtgcatcgggtgtgcatgaatacccaaagcggtttcaaagaactcgagatcgtcatgcgcgcgataccggcggtttctagcaatggcccgaacgaatgcagggtcaaacttataaacacccattagattccaatctgcagaggcgtgatgctggcttgaagggcggtcgggtagcactgctgtaaggcgcagcgcatcgtccgccagtacgcgcagggatcgtccgccctgtgttttgctgactacggcaatattgcggtcttgcgaccgcaacaggcgttcgatcacatcgaagtctatgaccaaattctccgtgaacaccagcacgtcgccatcaacgtgggcgatctcatttgccgttgctgcgtccacgagacgtccggcattcggcctgggcagagcgcgtaagcagagctccatcccattcagctcgccaccgaggtcgccggctatttcgcctaaagtttctcgggccagcaccatcgtcctctgcaccccagcgtgtgccaattgagataataagcgtcgcagaaccgacgtgccgccaaccacacctagagctgctgaaaagcgcctcttacacgtcgagatcatctgttgtgggtcggtaataacaatccccaagctctgaacttcgcgcatttcgtcgatcctcggactgagaacttcctcaaaatctatctgagggcgagcgttctatctactaccagggcaaatagtattggtgcgacttcgaagtcggactgtaggtgaagtgcgcaaaagagttgaggtgtattgatgggtcaatgttccgtaagaccgtatgtccttcttcgggagtgaggtggctcgccctagactgttcttccgagggttgctcggacaggccgggccgatcctcataacaggaggacgagccgtggctgattatagagaagcttttgtcggaatcgatgttgcaaaattaaagaacgcgattgcggtcgccgaatccggtcgaaacggcgaggtacgatactggggcgaggtcgaggcgtctgatgcagggatacgtcgcgcgatcaagcagatcacggcgaagtttgaacacgtgtatttctgttacgaggcggggcccactggctacgggctctaccggctgatccgctcactcggccacgaatgcatcgttgtggctccatctttgatcccgagaaaaccaggcgaccgggtaaagacgaaccgccgcgatgccatttcgctcgcccggctattgcgggccggcgagctcacggcggtgtgggttcccgatgaagatcatgaggccatgcgcgaccttgtccgggctcgcacgagtgccgtcgagacgctgcgcacccatcgccagcaggtcaacgcgttcatgctcaagcacggtcgtatctatcccggcaagaggagctggacgatgcgctaccttcgatggctgcaagaacagcacttcgaccatcctgcccatcagatcgcgctgcaggagatggtcgaaacggtcatcgccgaattcgtgccccactggtcactcgctgcggtcgtatgcgctctgcgggccttgcgcggcgtggacttgatcgccgcggtgacgtttgcgacagaagtgggagatgccggccgctttgagagcccccgccaactgatggggtatctcggtcttgttcccggcgaacgatcgaccggggagacaacaaagaggatcggcattaccaaggcaggcaacagccgagtccggactttgctggttgaatgcgcgtggacgtatcggtatccgcctcggatcggcaagaggaagctgtatcgcctcgaagaggtatcatcgtcggttcgcgagatcgcctggaaggcgcagacccgcctgacggcccgctaccgcatgctgagcgcccgagggaaaaagtcgacggtcgtgtgcaccgcagtcgcacgggaactcgccggcttcatgtgggcaattgcaagggaggcgcgacagaccacgtcataacagccgcgcaccgactcgcgcattggcggaggcgggacaacggcaggggaatgtccgttaaccgctttgtggccggcaagtccgacgcccgcagtaagacaggaacagccccagacgcaaaatcgggaatgcggtagccaacccgcgtatcagagcttgatcaccgacgtctttcagttccgcctccaccaatgcgcaagctatccacctcgagcgttcctctacggaacgagcgactcgacgtgtctgcaacgttgacagcggacatcagagcggcaagcagaccccatagccggaatggcgcgtcgtgcgcccgtcgatggcagagcggcgaccattgatgttctgcgccacatggggcgtcaccttcatcgaccgcagatctttaacgaagtcctttgtgtcataggccttgtcggcacccagcgtgatcgcttgtgtccggtcggcgaagtgctcgatcatgtgcagagggcggatgatggcgacgctgatcggatagttggcaagctcgggaccgcgatcgggcgaagtggtcaagcctgatcgttccgacgtcgatctgacaaatgggtctgtcctcgttcggaagaagatattccgcaaggaccgtctcgttccagttcacgcgactcaggctgcccttcgccactagatgcgtgtgcgcaacgtggcttttcttcagccgaaggaccaggccttctttctgagctcccgtggccaccgcctctgtgcgaccggcctaaaaaatggttttgctgaagtccgcaagttcgccggccttgatgacggcaagcggttgcggccgcacgatctgcggcaccggtttgccgtgacccgcctgagcatcaacaacgcgccaacgccctggcgctgctgccgttgctgccacctatctcggccactccagctacagtgacacagcccactatctcactggatcggtggaccttctggcggcggagcgcgccttccttgatgggggcggagcgtgacttcggagctggtcgagaacccaggccatgcgaaaagctgcttgttccgctatgccaggcccatgtgacgggccgctgtgtccgcccaccatccggatgcggaagacaagatcggggtcgcgatcggtcgcgcaggaccgacgctgcgccacgtaacgagcaggttggtaatagatcacttggccatcgtcgagcgcggcgtcgacgtatgtaggtggaagagatcgctcggggctgaggttgtaatacgggtcgtagctgcgcagataccgatactcgtaggcgtcctggggatctccatactctgccgtttcctttagcgtgtacggcattgtcgagtccagctgggtatctatgatgtcggccagtgggacctcggcaaccacggcgcggaacaagttgggccgaaagacggccgttgcaagcaccgtacccccgccaccactctttccctcaataacgacgccgtcgcgggtggcgaacccacgctcaataagcccctcggtagcggagatgagatctgtgtgagtaatgcgcttttggtcgcgggtagccgcgtcgtgccatgggcgtccgagctcgccaccccctcgcacgtgcacgatgccgaaagctacttcgcggtcgagcaggctcaaacgcgccgtcatggaagagggccaagcgaggaacgagggcaatctcggtatcccgtagcagccgtacacactcaataacactggtccagggctcgttcgatcgcgccgcgcgaccaacgagatcgggacctgcaccccgtcttcagcctctgccattacgaccgttgcaaggtattgagtggcatcatacccgggaacgcgggcctcgcacaggaccaccgatcggtcgttggcgaaatcatgctcgatgaaggtgtcgggcgtcacaaacgagctaaccgagtaggtcaacttcgagcttcggaacggatgtcgtgcggccgaatagcaaccaccggccgacaggccgacccttatagtgcagctcggctcgtcgggaacgatcacagcgccaacccgcccgcttcgattacgcgagatcaggcgaggacggaggccttctcgttccaggaggaccaagtgctgttcgagcacgtggatctcgtcgatcgtcacgcccgctcgatgcggcacgacctcctcccaccgcgacggtgagggatcatctatcggcgcactcaccagccgccagtacggtccagcatcatccacccgaaacaggaacctgtcgtaccagtgctcggcatagatctggtgccccagttcacgcatcacgatccggcgccactgacctcccggctcgtcggcgggaagacaccacacctctgcagcccctcgctgaacgtaagaggacatgtccgaggtagtaagtacgtcgaggaataaccaagcgccgctctgagaacgccgaaccagcaccgccagtcgctcgtttgcctcctcgaacaccacctccgagtttcctcgcccgacgttcaagcggacgatctgatgatgttgccgccggtcaggccgctcccgtgtgaaaaagagcgtatgattgtcggcggcccagacaacctgcccgacgctacccgcgtctcgccagacatcgcgtccgtcggacatgtctcgcacccttaactcgtagcgctcggcaccgatgagatcaacgctaaacgctaggtaacgcccgtcgtcactcggctcgaacacaccgagccaatagaagacgtcggccccgggtatcgcgttcgggtcgaggacaagctcggccgaacctccggtcaccggccgccgccaccataccggatgaggcagcccccgctcgtgtccctggaagtagtcaaacggcccaacttggaacggtggcgtggcgccctcgcaaggctgacgcccttcgatctcggcgatgagctcagtctttagtcttctcaggtgagctgtcgcttgctctgcatagctgttttcggcttcaagatacgcgcggacgtcgggattctctcggtcgcgaagccatccataccggtcgacagtgacgtcgtcatgaaggacacggatccgtggctcggcacgcggaagcggtggccgcaggctcttgtcccacatcacaacgctcctgaaatgagaacaagcgtcgtattcatcaccgccctccactaacaagtcgatgcgtcgctgcatcgcgcttaacccgcccatgaaccggagtcgcgatccgctttagatgcttgcggccacagatttgtgcaggatgtccagaccacgtcgaagcgtctgctcgtcagttgtcaaaggaggtagaagcttgataacttgatcttccgctccgcatcgctctaccacaagtccctcttcaaaggccttgcggacgatcctctcagccagcttacctgtaccacaattgagccccaacatcatgccccttccgcgtacggagaggctacgagctcggttggtctgagccacctgccgaaggcgctccgctatgatgcgtcctgtctccatgacacgggcagacagcgcatcattcgtccagtactttcgcaaagcagcggcacccgtcacgaacgcaagattgttgcccctgaaagtcccattgtgttcgcccggccgccaaacgtctaattctggcttgagcagcaaaagggacaaaggcagtccgcagccacttatagacttcgacaagactacaacatctggcgacaaacccgcaaactcgaaactgaagaaattgcctgctcttccgcaacctgcctgaatgtcgtcaacaatcagcaggatgccatggcttctgcaaatccgctggatcgactgcagccactcttttcgcgcggcgttgatccccccttcgccttgcacggtttccagaatgattgccgcaggtacatctacgccactgcttgcatcagcgagcaccttatcgagatattccgaagtgtcgttatcggcaccccaatacccgtcatagggcatgaacgccaccccggctggcggaaagcctgccgcgtcccggtagtatcgattgcccgtaaccgcgagcgcacccaagctcatcccatggaagccgttagtgaatgaaactatgctgtgccgtccagtggccttgcgcgcgagtttcaaagcagcttccactgcattagcgccggtaggaccgcaaaactgaaatttgtaagtcagaccacgtggccgcaatattatggcgtcaaaacactccataaactctcgtttagctggcgtagccatgtccaacccgtggattattccatttgatctcaggtattgagtcgcttcgtcaagaaaatacggatcgttgtgaccgtagttaagaacgcctgagccagagagaaaatcgataaactcgcggccgctctcgtcatgcagaatggcgcctgcggctttctcaaacaccacggggaacgatcgcgaataaaatcgcacgttcgattcgaggctctcgaaggcgtagagtgaattggacttactctcgtttgacatgattttcctcaacaagacgatggcgtcagagcggcgcgcctcatgctcttgaaaccgatgccaatgccacatcggaattttacgtggctccgcggttttacacggcgatgcaggcccacgcgcctacccaggctggcagtatcgtcggtgccacttcttcagtatattcgcgtgttctgatatgactagacgagaaccaggagagtttgcccctggtgcctttcgacatccgatttcctgagagcttgaaactatctgagtcgcactacttattgcagacgcgagaggacatgtagccgccatgcagccagatgcggctcccacgataaagacttggcgctccctccaagatcggttccgagccgagtctgacgatcagccatgtgggtaactcactgccgcggtgcagaggccgcgagctctgaatgcaggctcacaagagtagcagcgtggccgatgttcgaatcacctgtactccctttagagagtgcccgagcctgacgttgcttggtcgcttcttacaattcgataattccaaggcttattgctttaatcgctgcgacggttctgctcgaagtacccaacttccgcatcacgttcttaatgtgaaagttcacagtattttcggaaatccgcataataacccctatgtcccacgaagatttccctcgtgccacccacaacacacactctttttctcttaaagaaagggcaggaattttttggacggcgttcaaattcgcgattttcgcgactctcagatggaaatgggtcgcggcaagttgtaaataggcgattgttctgtcgtggaattcacgctcgcaatgccgagcaaagctcatgatcgcgcagctacctctagggccacgcaatggaacagtaatgccggacctcaagccaaacattgcagcctcgtcaaacatgcgccgctcgtattcagtggtgcttgcgtcactgtacatgtcgctccatcgaatcgggccagcccccattcgactctctttgatgacaggggctatcgtctcgtaacccatttcgagacatcgctcccgccaaccatcaggataattcagaatctcttccgagtcgcatttcactcggttcagagccttatggtcgcttgtaagcggaccataggccagccacttgcagccaaatttaaacgcaaaagccgacaaaaggtcgaacaatttttttggttgagcgacaccatctgtcaggtcgagaagccggccgagctcgaccacatactcgtccctacctgcgtttgagaaatggatcgatcctcccaaggactgatcagaaactccggtggccgatccgcggacttgagggaaactgcagccatccgcgagtcttccacagtctcgctcgagtgacgaatcgcccgccatgtagtcaccggtgcacgacgcggcagccgatgaggcattaccgctctgcgcccccaccggccggtattgcagggcgctcaatgcaagtcgatggagatctggcatcttgctctcctccttcgtccgttgagtaatgtatatcgttgacgagtcctactcgcgtcgccaatgaggttcaaaagtcgtgccaagtttgcagaaagggggcgtcaacgaaattcttgttcgtttgtcagggatttgaacaccatgcagccagtactcagccgcatgccgctacgtcgtgggctcgacaaacgcgacagtagtgtccgttgcgtggttgcactgtgaggctatgcattacgcatcggccatttgcttgtccaggaagccgttcggcaatccaaagcgggagccgcagcctgctgcctcgactgcgaactagtttcagaacgaggcgcagacatagaagctcacatcggctcacaacgcgctacgatatccggccgccacccccttccgccagacggggttcccttgccgctcttacggtcgagatcactttcgcataccacaacggcgacgaggccatactcagggccaaacaggagacttcttcaacagcctgctagggctagctgtaggcgtagacatagatcctcacagtcagagaaatcgtaagcggtcagccgatagcgtcaggcttgaagttccagggcatgagcgcttcgatttcggatgcgggccagccttgagcaatgcgggtcaaggtctgcgagagccagtcgagcggatcgacgccattcattttgcaggtctgcagcaaggtggccaccgtcgcccaggttcgtccaccgccctcgctgccggcgaatagactgttctttctcgtaatcgtttggggcctgatcgcccgttcgacgatgttggagtcgatctcgatacggccgtccgtcagaaagcgctccagcgcctcgcgccgggtgagcgcgtagcggatcgcctcggcggttttggattttcccgagaccttgcccagctccttttcccacagctcgaagaggctggcgacgatggccgaggacttttcctggcggagttcagcgcggcttgcggcatccttgccgcgcacttcatcctcgagcctccacaactcggtcatggcgatgattgaatccgttgcggcttgcgagaccccgctgatgtgcaggtcgtaaaacttgcggcgcaggtgcgcccagcaccctgcgagctggatcgtttcattgctgccggttttggcccgcgccttggccaggttggtataagctgagtagccatccacttgcagaatgccgctgaatccggcgagatgacgcgccacgcaatcggcgcccctgccgtcttcaaaacggtaggccaccatcggcggactggttccgccatagggtcgatcatcgcgtgcgtaagcccacagccaggccttggtggttttcccggaaccgggggcaagggtgggcaaggtcgtctcgtcggcgaagaccctttcgccctccttgacgcgctccaggatataatcggcgagcatctgcaactcgaagcccagatgccccatccactgcgccatcagtgatcggctgacctcgacaccatcgcgcagatagatcgcctcctgccggtaaagcggaaggccgtcggcgtattttgacacggcgatataggcgagcagccgctccgtcggcaggccgctttcgatgaggtgtgccggcgccagtgcctgaaccacgccgtcgcggcctcggaaagcgtatttcgggcggcgcgtcacgatgacccggaacttcggcggcacgacgtccagccgctcggagcggtcctcgccgatcagaaccttttccagccccgcgcagtcggccgggacttccggctcgataacctcctcgatgcgttcgaggtgtgcggcaaagcccttgcgcggacgcggcgcacgcttcggcttgtccccggccgcgcggttgagttcgctctggatttccgaaaggccggtttcgacctcctcgaacgcaaaggacacctgttcgtcgttgacagccaagcgcagccgctcggaccgcgtgccatgttgcgtgcgctgcagaactttcaggatcgacgtgaggttggcgatccgctcgttggcgcttttctcgacggccttcagccgggcgacctctgccgccgcggctgcaagtcgggcctcgttcgcagctcgctccttggccattgcgaggatcatcgctttcagcgcatcgacgtcgtcgggaagatcggcaacaggcaaaaccatgggaggcaatagagcacaaaaacagccgttttcccaaccgttacagccacatgattcatcatgtcgcaggccggtttcagcccgttaacaacggccgcctgaccttggccgggcggatctttttccaatcgagcccggccagaagcgccatcaactgcgaatggtccagacgcatccgcgccgccgatatgcccggccagcagaagctttgctcttccagagttttcgaatagaggcagaccccgctgccgtcccaccaaactatccgaacacggtccgcccgcttcgatcggaacacgtaaagcgaaccattgaacggttatgtgccgcaccacataatgcagagcgtttttagcgtggcgtcgcgtgtatccacgttgacgcgcgcgccgaggcggatggcgacggtgcgctaaaaacgtgttggactaagccgcgggtgcgtttcaggtcctatgggtattgaatggtgcggctcgaaggaaaggcgtcgcaggggcggtgatgacgtacgccgccgctgggtgcacgggacgaaagcagcgccgatatggaattcgacaggggttgagattgccattgtaacctgccgggaaggatcggtaggcgcaacggcacgcaccttctcgggaccgaccggtttccggcggaacggtgcgacggtgacgatgaaagcgcttctttcatgacgtgtcccagcatcgcggcggtccggtgacgccgtcgaagatttcgatggtgatcatctgcccttgatgacaggccgggcattgtctgagggaacgcccggtgagttcctcgtagcggtcgcggtactccttcggcgcctgggtctccgatggggcgggaacggacatgccgagcaggtcgcggcattgggcaagcttttgttcgcgatagcgattgccgaggaaaccgtaatagcggatgcggtggaagccctcaggcaggacgtgtaacagaaagcggcggatgaattcgtcggtcgacacggtcatgaccttttgccggtcgccgtgccgataatccttccagcggaaacgcaccgctccatcttcgatatcgacgagccggttgttggagatggcaacgcggtgcgtataacggccgacgtaatcgagcacctgttcgggcccggcgaagggcggcttggcaaagacgacccactcggcctttcgcagcggcgccagatagcgccggaaggcgttgcgctcgttgagggctcgcaagtcggagaagaactgcagcttgccgccgtcgaaggctttctccaggtgctccagaaacaagcgtcggaacaggcgagagagcacgcggaccggcaggaagaagccgggtttgcaggcgatccattgcgtgccgtccggcgagaacccgccacccgggacgacgcagtgcagatggggatggtgcagtagattttgcccccaggtgtgcaggacggcgaagaagccgatctcggcgccgagatgtcgggggtcggcagcgatggtgcgtagcgtctcggcggtggcgcggaagagcagcccgtaaacgagcgccttgttctggtaagcgatggcggcaatggcctccggcagtgtgaagacgacgtgaaagtactgtgtttcgagcagctcggcgcgacgatcctccagccattgcgcacgggcaagcgattggcagcgggggcaatgcctgtcgcggcagctgttgaaggcgatgcgccggtggccgcattgatcgcacgcttcgacgtgcccaccgagcgcggcggtccggcacaactcgatcgccgtcatgacgcggcgctgcgcggtcgaaagcgacgtgtgctgggcacgataggcctcgccgtagcgacggaagatatccgccacttccggccccgaacgggccatcgggagctcagaaatactcaggtttggcgggcggcggcgtgggcgccggacggggcaaaagctcgaacgggcttgaggtggcgcagactttgttggtggcgatgcgcaggtagtgggcggtggtcgcgaggctgcggtgaccgagcagcaattgaatggtgcgcacgtcggcgccggcctcaaggagatggacggcgaaggcatgccgcaagctatgtggcgtcaccggtttggacaagcgggagagatcgtgcgctttcgcacaggcttgcccgactgcatcccgagtgatcgggtggccggcgcgatctccggggaagagccactcttttggccgcggcatcctccaatagtcgcgcaggatctccaggagcttgggcgacaacatcacatagcggtccttctggcctttaccctgctcgacacggacgaccattctctggctgtcgatgtccgtgggcttcagctgaaccgcttccgagatgcgcaagccagcggcatagcacgtcgtcaggatggcgtggtgtttgagatcaagcacgcagccgagaaagtgctgtacttcatccggactgaggatgatcggcagcttctgcggcttcttcggaagcggcaatacctctgcaggcacccagtccctctcgagtgtgacgctgaagaaaaagcgcaacgccgcaatggcgatatggattgagttaggcgccagcttcttctcgttggccagatagacctgataggtccgaatatcctcgcggccgagcaagtccggcgccttgccgaagtgtcgtgcaaacagcgacacctgccgcagatatgaaagctgggtattgagcgagaaattgcgcacctgcatgtcctcgctcatgcgctggcgaagtggggtcatgacgagctcctctgtctgatggaataggctgccaaacagccgtcccatcgtcgcgcagttggggctcctactgaatacatgacctccttgccgctccgcggtagcggagcgggttagtccaaatgcgattatgtgccgggcgagattatgtggcggagccgtcgcggcgccagccgaggcccgtctaatctggaattctccgccacataatagtcagatactgttcagtagttgcagcacggcgtcatttggtcggaaacggatgcccagatcgccggcgactccagccttctcgagacctttgcgcatcatctcgacatcggcggcggcatagcgatgggttgtagcgacctgtgcgtgcccgagccaggcttggatcgttaaaaggtcaacgcccgcctggagaagcttcatggccagtgagtgtcggctatgtcttgatcgatataggcgacactatctaccccgccggactatgtcgtgtaactagatttcgatcaaagatttcaatgctttatagatagcgtgtagagatagttcgtagcccttccagcaatccagcttgggaagggagcgaagaatgaagtatttcgtcaatgccgattttgcgctgtcgcggccgccagagggcccggtggcgatttacattattccttttgccgaatggctcgttgatcgaggctacggccttgtttctacaaggaaccaggtgctgatggctgccggcttcagcagttggcttcggcaaaaggggattggactcagcgacataaatggagagcatgctgggcgttatttgctcgaccgagtgcagcgcccaaagcttggagatgacgccgctcttcgacatctattggcttttcttcgaagtcaaaacgcgatcgccgaagagattgaggtcgatcacaacccgtcagcggtagaacaacatgtgcaggcatatgagcggcatctgcgagacgcccgtgccctgtcgcgtcaaacgatcataaattaccgacctgttgtccgggattttctcagcttccgcttcggtgatggcgagatctcgctcgcacaattgcgcgccgccgacgtgaccgatttcgtgcaaaagaaggtatcgcgcctcaatatgcgacgcgcaaagattgtgaccacggcactgcggtcatttctctcctatgcgcgttatcggggggacatcacgtcggacctcgcggccgcggtcccgatcgtggctaattggtcgctctcatccattcctcgtgcaatcggccgcgatgacgtgagccgattgctctccagcatcgatcgggatacgcccatcggatgtcgcgattatgcgatgatcctcgcattggcgcgactgggattgcggtcgagcgaggtggtgacgctcgagctcgacgatattgactgggtagccggacggatccgggtgcgcggtaaacacggacgtaacgaacttccgttgccggcggacgttggcgaggcgattgccgactacctgtggagggcgcgtccgcgcaatgccagtcgccgtgtttttctacgcgacaaggccccgatccgaggcttcgtgggcccgagcggactcgggtcaattgtcagacgctcactcaagaggaccggcatcgactctccaacaaagggaacgcaccaattccgacatgggcttgcctcggagatgctgcgtggcggcgcgtcgctgggtgagatcggcgaagtcctgggacaccgtcatgtgcagacaacggcaatttacgccaaggtcgatctcgacgcgttgcgaacactggctttgccatggccgggagaagcccaatgagcacattccgacaggctgttcaggagtacatcgagatgcggcgagggctggggttcaagctgcgagagacagaacggggattgatcgatttcgccgccttcctggaggccaacgacacgccacacatcacgacggaactggcccttgcctgggctcagcgaccgtcgcgggcgcagccttcgcattgggcgacacggctgggctatgtccgcgtattcgcccgttatcgggccgccgccgatccgcgaactcagattcctccaagcggcttgcttccctttcgcccgaagcgggctcgaccatatctctattcgaaggaagacatccaacgcctcctgtcggccgctctggagatgccgtgtcgatatacccgctgcaagctcaggccatggacatattattgcctgttcgggctgctgagcgtttccggcttgcggctcggcgaggcgcgcaacctcaagctcgcggacgttgatttcgacgctgcggtgttgacgatccgcggaacgaagttcggaaagtcccgtcttgtaccgatgcacgcatcgacatgcgcagtgctccgcgattatctcaaacgccgacgacagcattgtgcagcccaggcggcatctccctatttattcacttcgcaactgggcaatcgccttgatgtcggagacattcaccgaacattctatgctctgtctcgccaaatcggcctgcgcggcgcaactgacagccacggtccgcggctgcatgacatgcggcatgtgttcgccacgaacacgctggtgcgctggtacgaagccgagcaagatcccgagcggctcctgcccattctgtccacctatctcggtcatgtccacgtggccgatacccaatggtacctcaccggttcacccgagctgatgaaagaagcaatgcgccgccttgaacgtcgctgggaggatcggacatgaccaagcacgccagcctcgcgccactcttggagagctttttcctccaacgcctgatgcaacagcggcaggcaagcccccatacgatcagttcctatcgcgatacatttcggcaactgctgaagttcgcagaacgaagattgcgcaagccgccctctcgcctgaacttcgaggagatcgacgcgccgctgatcgttgccttccttgatgacctggagaaccgccagggtatcagcgtccgcagccgcaacctgcgcctcacggcgattcattccttctttcgctatgcggccttcgagatacccgagcattccgcccaaatccaacgcgtgcttgcgattcccagcaagcgcttcacccgaaccctcgttaatttcctgacccgtccggaggtcgatgccttgctggccgcaccggatcgatcgacctggtccggccgccgcgaccacgcgttcctcctggtcgcggtgcagaccggattgcgcctatcggagatcaccggtctcaagcgggatgatctgttcttcggcacgggggcccacctgcgcgtcattggtaaagggcgcaaggaacgctgcaccccgttcgccaagtctacgaccgccgtcttgagaaactggctgaaagagccgcagcgcggagaccaaggtatcctgtttcccagcgccagaggtgagcggctgagcgttcatggcgttcagtatatgctgaacaaacaccgtcagatcgcttctgccatgagcccgtcgctggagggaaagcgcgtcactgttcatcgtctgaggcacacgatggccatggacctcctacaggccggcgtcgatcgcgccgtcatcgccctgtggctcggccatgaatcggtcgagacgacacaaatctatctcgaggcgacgttggcgatgaaggaggcggcgttggcaaagacatccccatattccgggaagtcatcccgattccggcccgacgacaatctgctggcgttcttgaacagcctgtagatcccgctgactatgtcgtgtggctcggccgatcctgtaggaaatctcgttgttcctcagacgcttgcgttttcggtacccgacatagtcgggtggggtagatagtgtcggaagatgtgcggcgatataggcttttgggccaaggtcggcctgatggtcacggcctgggccaccgcacgccgcacgatgtgggttgctccgaagcgcgtcaggcgctcgttgcgggcgccgacgaatatcggtcgcggctcgtggttcgcgattccgtgctcggccaacaaggctgtcagtgctctcgccagatcctgaggaatggggatgacgcggtctctgcgccctttgccgcgcagcagcacttgcgggtgcgaccgttccaactgaaggtcgtttgcgttgacgccggtagcttcggagacccgcgcgccggtccgtgccaggaacagtaaaaacgtgcggtcacgccgaccacggggcgtccttggattgggcgcctcaatgagggcgtccacttcggccttggtgaggtgatgcgtcacctcgatgtgcgcccgttttatgggaatcgtcagcacgcgttgggcgacaccgaaggacgccggatcggcggccgcgacatggtggaagaacgatcggatcgccgctaggcgggcgttgcgcgtggcgatcgtgttgttccgcttctcctcgagttcgtcgagaaacgcgagaatgaggtctcgatcgagctcctcgagcaccagagccgccggcttcttccgcaaccgggtggcggcaaagaggatgagcatgcgcaaggcgtcgcgatagctggccatggtcgcgggagtcgcgttgcgttgtttggtcaagcgccggcgaaagtaggactccaggagcggcgccaggagtaagtgttcgctcatgctgcgcctccatcgaggaaggcgcgctccgccgccatggcgagaagatccaccgagccagtgaggtagtaggctgtgtcactgtaattggcgtggccgagataggtggcgagcaccgggagtagcgcctggacgttggcgcgttgttgatgccaaaggctcatgcgggtcacggcaaaccggtgccgcagatcgtgcggccgcaacgtcttgccgtcatcaaggccggcgaacttgcggacctgagcaaatccgcattgcaagccagtcgccgagaggcggttgccacgagagctgaggaagaaggcctggtccttgggactgggaaaagcggcatcgcgctcacgggcatagcgacaaagcgctgtttgggtcgtcgcgtgaaccggaacgagacgatccttgcggaacttcgtcttccgaaccagaagaaccccgttggtcagatcgacatcggaacgatcaagcctgaccacttcgcccgaccgcagtcccgagcttgctaacagtccgatcagcgtcgccatcgtcagccccctgagagggatgcctggcgaaatgcgggcgcatgcgtcgatgagcgacgccaactctgcctcgctgaggatacgtggaggcggaatcgccctggatctaggaaaggctctgcgcttcagggcttcggtttgggcgtcatagacagcgagatactcgtagaatcggcggagcacgccgtgacgagtggcgcggctgttggcggcgccgccgaacgacaggacgaagtccagcgccatagtccgggtggcgggcgcatcgaattgagcgcgttcaacgtagcggacgaaagcccgcaacgtgccggcttgtttgctgaaggcatagccgagcgagtgacgcaggtcgatgtaacgctcgaccttctcgccgaggaatcgggcaaaggcggtcatgcagcgcctcccggaaaggggagtgcgacctcggcgagttgcgaggccgcaacctttacgtacagcgccgttgtgttgatgctccggtgaccaagaagatcggcgacctcgttgattggccttcgctgcccgacaagctgggtggcgaggctgtggcgcaggagatgtgcacctgcgacccgcccgagttcgaccccgccatgtcgcaatcgcttcctcacgatccttgatacaggcgccgcagacttgaacgctcccaccggcggcgtgaacgacaggaacagatacggactgtccaccttcggtcgagcgcgcaggatgtagtcgacgagtgcggcgccggtctcctcaaggagtggcaccacccgatcacgcttgcccttggtgcgccggataaaaacctcgccagtacgccagtcgatatcctgcagccgaatggcgcgtaactcgccgttgcgaatgcccgtggtggcgagcagcagcaggacggctcgatcgcggatagcgaccggcgtcgttgcgccgatcgcatcgattgcgcgccgaacgtcaccccatgcaaggcgcggcggcagatgcgccaaacgccaatagggcgtcctcgggacgatgcgggcaagatcttggcgatggtggccagcccaacataagaaccgaagaaatgttcgaatgtgagaggtcgctgccgtgcgggtgccggaggtcgccgatagcgacagccgatgctcgacagcagcgagcacgtgctcggccgtcaacgcctcaagattttggccggggtggcgatggcggaaccaatccaaaaagcggcggccgcccagaagaataccttcgcgggtcttcggctccaggccccgtaccgtgcgcagatagtccgaaaaggaggccagaagcagagcatccgggtcagcctcttcacttggaacgggaataatgaaccgctccggagccactcgccgtgcgtgtgccagagccgatacggccccgatccgcggagtatctgtagtaaacgtgcccaaatagctgtcgatgacatcttgatggattggcatcaagccacagcgcgtcgcggcaaactggctaaaacgcgcaacccggctcaggtaaatcttggcggacgctcgcttataaccgagcgtaagaaaatgctcggcgaggcgatccatctcgccaccgagcgcaccgctacgtaggcgcttgagcaccccacgatacgagaaatagaactcgagcatgttgtccctccggaatagcggcgcggggggatcccgcactcatccaagaggcacgaaatattatgtggcggagaattccagattaggcgggcctcggctggcgctgggacggctccgccacataatctcgcccggcacataagaacgggtcgaggccgccgtccctcaccagcgccatcaaagacgcggctcccttgcggaagtcgaccggctggcacgacacgtaaaccacaactccggaagcgatcatacctagcggaccacccggagaatcttggccaggtgatcgggatcgacatcggcgccggcgcgcaccacgatatcgcccacgacgatttccaccatcgaactgcccaccgcttcaaagcgcgtgaacttgactggcgcgggcgctccctccgtcaatggcgcgaccattcccgacgagagcgccttacgacgccaggcatagagctgcgacgggtccaatccctgagaccgcgcaatcgccgacacattggcccccggcgagagcgcttcggcgacaagctgcgccttctcctcgtccgaccaatgacgcggcttgcgtcgagaccgcaccggctccgccgtcaggacctcgaatgttcgatgatgatgatgattcacactgtcgctcataggtttctccgcatgactcatgcagagaatgaccgttcagcggccctaaagatacgtggggtgacctacccgcttacgagaaatcgaatgtctgccttatctagtcacgcgttaagccggccagatggggtctgctggtcggtttcgaatcactgaagcgtcgacagcctcagctttctcgtccggatccgatggatagtctatggaaagctcacaactggttagtccggaaagtacagcggagtatattgttcctgatcatgaaggtccgagaatggtgaaatagaccaatcgattgattcaactgcgcgttgaattatcgtatcagcgctggagcgcgagggcgctacagcaacgacatatccaattcggtcacagtaatcaccatttctgactattggcgttcctggtctaacatacaatttgacgtccgcgacaccgggtatagctgccgcccggtcgataccatcaatgtaatcaagtgtgccatcgcgatccgcaatcaaggatcgggcggtcgctgttcgtgactgcctcttcgacaaattgcattgttcaccaatagcaagcttgatgtgctcgccgatgagatcgacgtcgaaggccagctgaaccaattgcggatcaggattaccagcaagtcgcgggttgacttcaataacgactggaccgacctcggtccaccggaactcaatgttcgttggtccccagccaaggccgagtgcccggaggcagcgttgtacaacatcaacggcacgctcgtactgctcatcggtcaagggtgcaggaaaggtcaactggcggaacacgaaatgcggcggtgggccatactcagtgatgcctattccaataacttcgtctcccatgatctcggcgatgtaatgagggccatccacgaactgctctaccaatacctcgggtgaagatcgccacatgtgcttcccgcccaatagataatctgtgtgttcagctagctcgcgagcgtcgcgacacaagcggactcctcggctaccgctgccgactgcaggcttaagtactgctggcaggccgatctccgctgcaacgcattgtacttcggcggctgtggtcgccgaccgatagccaggcacgggaactccggctgccgcaaggacctgacgttgggcggccttattgcagcattgttcaattgattccggatcaggtccaggtagattgaaattccgacagatcttgccaactgtcgcatagaacgactctgcggcagatgtaactccggctatgtcgaaactcttacccagccgagaatattcgccgatcagagcatccaaattggttgtatcgacgcgagcgacttcaatgcgttccgccgcgacatagtcgtaaagtgctggatctgccgccaggattattggatgtagccgaagacgccggacggcttctacgtacgaccggccattagtccgcgtattttcaattaaaatgagcgcttttcgcattttatctgcctctgctgttacgttctgtgggtggcccaggcgatctgcatcagttgtttcagccgctgaggacggtgcccactcccggctgtaattgcgcatgcacaatcggcgaacgcgtacatcataaagagccagagtgaaggagcgtgctgtcccgaacatgattttcccactcacgggcgacttctgacgtattcgagagcatcttgagaagctcgtcgcgagtcgtccagaggagccattcgtcgtcgtctattcctaatgttggcaaccgaaggactgatccatggggctctcgatgacagtgtcctgatcgatcgaatattctctttttgatgtaccattcggccacaagtgagtagatgaaatcaggggaccagttcacccaagcaagcgcgaatgcaaggcgaccaagcggtgctagcaaaccacgacccctaaagtcgtcgcgaaaccacatgtcaccgcgataagcgactcgcccggtaatgctgcgagcgctgggtgcgtaacaacgacacgttgagttaaggcctgatttgccgacggggtccgcaaagcaggcgcgcagcgactccagatgctcaacaagtgtggttttggatagatcgtatagtcgcaatgcctgtacatgggcgactctgtcttcttggtcacgccctacaatccagaaggagctctcaggtgaaagatcagagtagttcggattgaagttcggagtagttggatatttgcctggaagtttgctggtgatcgccacgtactgccgaaaatcgtcgcccattgcaatattgaggcctgcgttgcgggctacatcatctgcgcaggaaatgtactttgaaacgtcaagtgtggtcacgttgctttgcatgttggtacaccccgttttattgcatcggacggctctatttctaaagctctggccaacgctcggatactgcggcattaggtgggttgacgggcggggcggctcgcggcctcgaaagggagttagtaccatttaccccggaccgccctagcgtttctgaatgccattaggaagctcgcaacggcggagcaagtgttggcacgagaacttgttcgatataggcgccgaacgctatgtcatgcggatcgaggaattgacccctcctattgcctcacccaggaatgttactgaagttgagggcactgagatacgggcgcgcactccaaccagtcgccattgcgtatgatctgcccggctatttcaatccgccaagccttgacggccttttgtaccgtccgcaggcttttctccgtgaagcgtgacggatcggcgctctttagacgctgcaggaccgaggctgccgagagcgccggatccgcctctagccacgctcgaatttgggttcgaatggctccagcaggctcggctttttgggtaaggcttagtccgtcgatatggccgccgacgtgtcggccgtttctctccccgcctgccaggccgtcttcaggctcgaggtgaatcgctggagatcgatggcgaccggttcttcgggcccgcattcgagccacggcgatcgacccgctttccgagctcctcctgggcagcacggatgcccgcaaacaacgtcaccggattttccctttccagcatgccgtcgtcttttggctttcacgatcgggcgatccgtcggccgggtagctccgtccttccaggccgttcgcaaactcgcgaggaaaaggtcgatcggctgagctatcccgtcagtgcgcatggccggcggcgtgtcggcaagcgcagcgagtcgctcctgcagggcgcgaatatcgcgcaatagcaggactggatcgagcccggcgtagatttcctgcagacggagcgagctgcatcttacgcgcgagcgtcggcaatcaggcgctgatgcggcgtggctgggcggactatacgtcttgcgcacacgagcaccgtcgcgctgcttcgccattaatttgaacgatggctgaaagaagttcacgaacagccgcgctgatcggtagagcttcgctagcagcgtggcggcctccagtccctggaaccgacggtatccgaccatcctgcgcaccacggcgccattcttctgctcgacaaaggcccggtcgttcttgcggtaggggcggcagcgcgtgaagacgatgttggcggcgtcacaatagccttcagcgtctcgttcatgaagacggtgtcgttgtccgtatccaggccgagaagcgcgaagggcagttgcttgcgcaattctgtgagcacactcctcaacagtgtctgttcgcaacccagcagcggcgcacattccgtccagccagtcgcgatgtcgtgagaacaagggtttggatgaagctgccgcgagccctagggccgcaatgggcgacgagatccgcctcgacaaaacctggcgccgtcattccagcgcgccgacgccggccaccgcgggccaccacacttcggcatccggcagactacgatcgaatctcatcgccccttcactccaagcacaaacgccatctcttggatggcgcaacggcgctgagctatgcctgctacttccgctggccgctcatcggatcgcgcttcaacgtctcctgcaccatcagcgacaggccgggaaagcccatgcgcatatccgtatagccggtcgcgagcgagaccttcacaccgatcgggaccgggatcatcgccgctccagcacatcaagaatccgaccgagggcatcagtgtcgatgtcattctggacccccaggcgacgcccaccgcccggctcgatcgtcaccatgcttgccttcttgcgcgagcgaggggccggcggcggctccggtgataccggcctcggcggcactggcgatgaatgtcgccaggagacgtggtctcaagagagcggttgtcgcgcttggccgccggctggaaacgatcatgcatcgcatgtggagtgacgaaacggagtttttgctggagcagaaaagaaggtcttggcccggctcaacgctgctgattgaaggctccgcgccgagcatggggtctcgagaccgaacggtggaggtgaagatattccgcctccggcggtatggatgtccttcgcaggacgatggatgaggtgagttcgttgcaagcgctgtcccggtcgcatcagttgcggtcagggcgtctcctaaatttagtctagtgcccgtccataaacgcctgtttttgtggaattttcaaaggtttcttgccggctgacgcgtgtttcttggacgcgtgatggcgcaatgccatgcagattatcacccgaagagcgatctggcggcaatgggtcatggggtatccgccgacgctcgccggggtttgctctgaacagtgccagacaaggggagtcaggtgtgccggaggcgggcgaagagggagagattgtaagcgaccgccgaggaccagacataagccttgaagtggtcgaggccgcgccaggtgcagcgccccaagccataagcgcgtttcaggcaagagatgccggcgtcgatgccggcgcggaagtttctgagcttgcgatagacccagcgactcctgaccatgtcttcgatcttgagaccgcgcttcttgtggaaggccatgtcgcgtatgccgcgggctttggctccgctcagattttcgcggctggcatagccgccgtcggccgccgcctgacgcggcggctcgccgtaaaaagcgatgtggcgttccagcatcggcagcaagcgctcgctgtcggccgggttgcccgcttcgatgacaaggtcgaggatcagtccgcttgtgccggtggtcagattgagtttgtggccgtagtcgacgtcgcggctgcccttgacgatgatgtcgacatgcggctcgaacaggctcgccagcttctcgccagccggcaccgcctcgccggccaggacccgccgctccgtctgggcaatgatccgctcgaccagcggcttgtagcggcagacttgcgcctgccagagttcgaccgccgggcccgccgtgaggagcaactgtccactcgcctgctgcagatagctcaaggtggtgcgcgcgatcttgagcagttcgcggtagtgcttcacccgtttcgggcgaccgcgggtatattcgatcgctcgagcccgcttcttcgccgcgcggcagtgatcgtgccatgggatggcgcgacccagtgcatcagcctgctgcaacagtcgcaccatcacccggacagcgtcccataacaggctgctgtcgctcggctcatggatcggtgcggcggtgacggtgctgtccacacgcacgaccttgccgctttccagtttctcctgccgggcgctcgccagcagcacccggttgatctcttcaaaggtttgcgcccggatcgggctgattgtcttgtgcaagaccgacttcttcgggttccacccccacggcaaccgggcaaaggcccggaaagaggcggagtcttcgaaatggaaggccagttcctgatagatcctatgaggagaggtggatagcgatccgcgctgtgacaaagtgatgtcgctttcaatcaacaccttactctggagaggccgaacatgctcgctgcgaatgaacgacctgaagcgccgaccgctatccgcattgatcttggcgcaatcttcgtctccttggaactcagccgttcgaaatggctaatcacctcgctgtcgccgggcggcggcgagaagatgtcgaaacatgcggtggcggccgacgacatcgccggcctgctggcgcggtttgccgagctcaagaggaaggcgcgggcccggaccgggcgctactttcccaccatcgtgatccaggaggccgggctcgacggcttctggatccaccgggtgctgcaggccgaggggatcgaaagccacgtcgtcgatccggccccgattccgacctcgcgccggcggcggcgggccaagaccgacaagatcgacggtgagacgctggtgcgcgcgctgctcgcctataaaaggggcgagccgcgcgtctgtgcgatgctgcgggtgccgacgcccgaggaggaggaccgtcgccgcatctcgcgtgagcgcaaggcgttgacgaacgagcgcgtacgccacgtcaatcgcatcaagggcctgctgttcagccagggcgtctccggctaccagccgctgcgccgcgaccggcgcacgcggctcgaggagctgaggaccggcgacggccgaccattgccgacgcatcttaaggcgcaggtcggccgcgaactcgatcggctggagctgctgatcggacagatcaaggcagtcgaggtcgagcgcgacgccatgctcgctgccgcgccggtcggctctgcgcatttcgctgattgtgagcagccggcaccggcgatgctgctcgccttgaaaggcatcgggccggagtttgccgctgtcttgtggtcggaggggctgtcgcgtcattttgacaaccgacgacaggttgccgcctatgccggccttgcgccgacaccctggcagagcggctcggtcgatcacgaccagggggtatcgaaagccggcaatccaaggctgcgaacgacgctgatccagggggcctggctgtggttgcgccatcagccgcactcagcgctcagcctgtggttcaagcagcgggggaagcagaacgatggtcgtctgaagaagaagaagacgatcgtggcgctcgcctgcaagctactcgtcgcgctgtggaaatacgtcaatgccggcgtcgtcatcgagggggccgtgatgaagaccccctgatcccgatcgcaaccgaaattctgcaatcttccaggacccgatcagtcctggcggatctaggtgggacgaaccgcagttgagtatggcttcaaacgccgcttgatagaatggtctcgtcctcctgagcccttgtccgccgcaagcgggatgttggttccgctgtctcgaacagcgaccgtatataagttggatctggcttggcaacgagccgcgtcttgcaatcgggctcagaccgtggatgccgcaacaaccgatggaaagcaaaaaaagtcaccctgacgacagttccacattgacgctcctcatataaactcaactggcgatgctgcttgagcagcgcgcagcgcagcacagcctcggccggcagcccctcgcggccggtctccttgaggccatgccggcgcaggtcccgcgtcaccagcccgagcagatcgcgatgctcatccagccattgcgacatcaccttcagttcacgaccgatctcgtgttcggcgaaaagatcgaatatgctcgccttgtcaagcgaatcgaagaattgaccccccctattgcctcacccaggaatgttactgaagttgggggcattgagatacgggcgcgcgcttcatccagtcgccatcgagtatgatctgcccggctatttccatgcgccaagccttgacggccatttgcaccgtccgcagcgctttcttggtgaagcgtgacggatcggcgctcacaaggcgctggagcaccgcggctgccgagagcgccggatctgcctcaagccacgctcgaatctggggctcgaatggctccagcatgctcggccttttcgggtaaggcttggtccgccgatagggccgccgatgtgtcggccgtttctctccggcctgccaggctgtcttcaggctcacggtgaatcgctgcagatcgatggcgagcggttcttcggtcccggcattcaagccacggcaatcgacccgctttccgagctcctcctgggcggcacgaattccggcaaacagcatcaccggatcttccctttccaacatcgcctgcagccgctccttatcggcctcggccacaccggaatgggcaaccaccccgcgcgataggcggcacgggcggatggtagcgtttgacgacgcgggcgccgatccgtgtcttctctcgcagcttgaacgaaggctggaacagattgccgtagagacgcaccacgtcgtagagacgcccaagggcagccgtcgcctccgcgccgacgagccttccgtaaccgaccagccgtcgcacgatcgcgccgttcttctgctcgacccaagcctgatcgttctttcgatacgcgcgcgaacgggtcacctccaatccctgacttcggcaccagcagaccacacgttcgttcatgaaggcgctatcgttgtcgaagtccacgccctgcagcgggaatggaaacagcgagcgggcctgattgagggcagcgataacgagaccgctttcgcgcgtgcggactggcacgcactcggtccagcccgtagcgatatcggttagcaccatcgtctgcacgaaactaccggacgaagaggtccccgaatgagccacgaagtcgacctcgacataaccgggcagcggatcgttccagtccccgaaagtgcgcaccgggaccgagcggcgaacagcagaactcattccagcgcgccgacgctggccaccacgagccaccacacgtatctctgacagcaaccggtccatcgtcgccgcactgacggtcagtagcttatcgcgaagctcggtactcagatcgagccggccgtgacgctcaagagctggcagcaaaatcgggatcagcggcttcagacgtttcgagcagaggcgatcggatgcttcccacagagccaccagcgcttcccgaacctcgggaccatacctgacagcatattgccgagcgcaaggcggctcgctctcactagggcggagcactcggatcgcatgcttgcggtgatatccggtaactgcgacgaactcatctaggatcctttgcttgtccgcccgacagctcgatcgatatcgttcgatgatcgcctcgaccagttccgtccgtgtcgccatgctgatccgccgtgccatccatcccccgagccggaacagcgaaccatggccatcccatcgggagcatcaacactatcggtaacattttgcttgaggcaatgcggggtcaatttttcatttcgcccgacacgcctggacggtgcgttcttggcgcattgtcggctccggcggttacgggtttatctttagaatcagtagcttgatctaaagtatacctgaagccgccgggctttgcccgccgagatatcgtgattaatacaataatttcagcagtttaacgtttatggacgggcactagtctagattagaccgctgcattcttccgaccccatggtgggagggccagggtgccgatccccgaaaagaaaaaagaacccgcggagaccatttcaacgctagccggaacgtaaagctcaaaagcgcttgaccacaaccgccgaatagagaagtgctcgcaccaggagttgcagccttcaggtcatccggccttcaccgtgggataccgtcagcctcgcgcaagcgacgatgtgctgagccagtgcgcatgcgtttgtcaccactgcccatttatagcgctgaggtttgcgacatcccgcaacggtacgttaggccaccggcgttgcatcgggagggatggagagggttgcaatcgccgcaagcacagatgtgatgcccgccaaaacgaatatagccgacaacgattctgtgatcactaccccagcaatggccgctcctagtgggaagcccgcttggtttacgcttatcgaaatggacatcactcgaccaagctgtcggggattggtgcgccgttggcgcaaggtcagcatcgcgacatcaataggaccggacattgcgccagcgagcaacaggccgatcgtcaggccacggaagccgaattccgctgcaatgggccacgtggcaaaagcggttacggccattccggcggtcataatgtggcgctcgcgcccagtggtgcacagatgtccagcgaggagcgcaccaacacctccggcgataccgaccagagcccataaaagccctactactgtactgcccgccgcaacagtgtagttaccggcaacgaacaccggaatgaccacgtgaagggcgccccatgtcatttgatacagcgactgggagacggccagaccgcgtaatgtgggctgtcggaccaccacataaatgcctttgatcgcttggcgtagcaaagatgtgcgtgaggatgccagccctggcaggcgctggacctgggataagcagaccgcggcacctgcacaggccgcagcgattagagacatcgcagcttctggcccgagccatccgacgagtccgcccgccatcgccggccccaccacatcgacgatggaatagaccgcagtgtctagcgcattcgcctgatcaagcgcgtgtggtggaacgagtcggggcaacagcgtgcggattccagcaatgcctaaggggccggctagcgaaaatagcatcgccagggtgcatacgactggaggactggaccaaccaagccaaccggcaaggctaatcgcggtaatgaaggcagtgctagcgatcatgtcgatccttactgcgattgtcggtcctacgcaatcaagcaaaacacctgcgagcggacttacaatcaggcccgggacaattgctgcaaatgtaagccacccagccagaactggtgacgaaaaacgcgccagcgcgaacagcaccaatgtgaggacgaacatgcgtccggccaggcgggacaaggttgcagcaagaagcaaggagaataggccaggtatcttcgaaaggcttctgtatgaaatttgtcgttccatggtgacctgcacacgggcgctatgttggttgcagtttacgagacatccggacgtgttactggggggccgggtcctttcgagcacacgacaagtccaagagcagcgtatccgtagccgccgacaccttcccgcatcagacaatcggcactgcttttggccgtgtcgccagtctaacaagtcgagtgtctgattctgtttatagactcgctccgacggcgtgccgcatgattaaggctgaaaatgaaaacctcctccagcgatccaggcggagcacccgctcgcctccttcctaagatataggcattgatggaaatcgaagaatagcccaacacgatactaccaacgtaaataggtgcacgagatggcgctctatgctgagactctccacgaagctcagtgcgattatgcctttgttcacgttagtggcggtgccgaccacatgcttatcttctcggtcagcatgatcaaagtttgcacgtgatctggtaatgttagcccccgcaatgcgagttgaagaatgcccaacgtccagagtttagcgattattgtcactgacccgcgactgataatctcgacttggaaagatcgctgtccagcgccgctgagctcggtcggcggcatgccaattcttgcccgcttggtctctcaattggcacaggcgggggtacaaaaaacgatcgtgttcgcattagatggtatcggcgacgttaaacgtattctcaacaaccgcatgaagcgcatggagctcgtgatacgtatcatgccgaccccgggctctggtcgccttatagatctagcaactattacggaaatcgctgagttccacggtcaagttttagtgttcactgagaacgctgtcatcgatccctcactgattcaacgtttattgcgatcatctgaccgcaatatcacggtagtaagcagatcagaacgcagacgatgcttgcgtttattgggcgatattggaggccgtcttactgccatgttgcccggtgactctcccattcgagaaagtgcttctgcagacgttagccccgtcgggatctataaatttgatcccgcacttctccgagcgattgctcgtatccgcccccatcggtttaatgacgatctggagttcttcgaaaccgctttagggcttcaacgccatcaaatttacttgatgtatgccgaccctcaacacgtaaggagagtgaatgatgccaccgatcttgaggcggcaaattttgcgtctagttccagcggcgaccagtttagtatacttgaacgattgcaagcggggaactggcgatatccagccagtgagcacatcttgctctgtaatcatcattttcctccagcctcagtagtcgaccgactgcgcgaacgtttgcaggacctgctctatcttcagccctccgaccagctcgatattatagcaaagctctcggaaatgacagatcttccggctcgaaatcttgcagttggtaacggcgtgggcgagttaattaaagccctctacggctacctcgatccgagaatcgtgattccaaccccaacatccgcgcagtacattgatgccgtcgaaccaaataaagtgagtcgtttcgagcttccgcctgagaactttgacttagacgtggaggctttcgcaaattttgcaaaaaggcggcaagcgtccgtcgctgtactggtcaacccaaacaacccaacaggacgcttggttcccgtccaggagatagaatggttggcgtcacaactcgctatagagaagtgccggctcgtggtcgatgagacgttcatagagttttcagtggcagggaaaggaaattcggtagagaagcttctcagcgtttttccaaagatggtcattcttaaaagcctaggtgcgataatgggcctgggaggtgcccagatcggctatcttgcttcgaaagacgaacaactcacccacggagttcgccggcggcttccgcttgggaacataaatggcatcgcagaatatctcctttggattttgccagaatttcgcgaggagtgggaagcaagctttcgtcgcactcgagcagacgttgtgtccttctctcgaatgttggatactatcccggagcttgaggtccacccttcccaagcaaactacctcttctgcagaactcctgaggcttggccaagtgcgaagcatgttgccacgatgcttgcgaagcgatacggcgtgttggtccagaactgtgaaaatcagtgtatgaagtatggtgaccgatacctgcgcttgactgtgctaccctatgaggagaatcgttaccttgtgtcggcactccggcggattaatgaagaactggtagaatggtcgacacaaagtaagcgcgcgggtacggcgtatcatttggggtgctgatcttgaattttctgcatgagtcatgcggagaatcctatgagcgacagtgtcagtcagccgcgaacattcgagcttttgacggcggcgccggtgcgggcgcgacgcaagccgcgggaccggccggacgaggagaaggaccgcctgattgccgagacgttgacctgccccctggaatgtcccgggttcgaggttggtctgttctccgaagatggagacagagaacgcagcgatcccgtttcgacgagcagatcatcggcattttgcaggagcaccaggctggtttgtcggccgtcgagctgtgccgcaaatacggtgtcaccgacgcgaccttctacaagtggcacacagagtatggcggcatgtaggtctccgaggcgaagcgtctgaaggcgctcgaagaggagaatgccaagctgaagaagctgctggccgagcagatgctggatgccgccgcactccgcgagcttcttgcaaaaaatgtatggtccgcctcgtccgtgcaagggtacgcgacatcgtgaatgacaattccagttgcataaatgtatccgggcctctcgcgagtgggctgcggttgcagccaggccatgagatccgcacatgccgttcccaataaatggttcgggcacgaagcccgcttttttgaacaggacttataccaacgagcggtgatcatgaccgatgcgcccattcgcggagtccgatggacatgatcttccacggctggtcgacgagcttgttccatgcggcgcagcaatgggtgacgatgtcgtcgtagtccttgaagatacggttggagagccagttgtcgcgcatgaactgccagacgttttcgactgggttgagttccggtgagcgcggcggcaggaacatcaaggtgatgttgtccggcaccttcagtttcggcgtcacgtgccatccggcctgatcgaggatgagcaccgcatgggcgccgtcatcgacgctccggccgatctcggcgaggtgctcctgcatggcctcggtatcgcaatagggcaggaccaggcccgcgccctttcccttccgcgggcagacggccccgaagatgtaggcccacatatgtggacggctcccgcttgcaagtgttttctgcagatatttttgaccggatcgcttgcttccatatgtgcggccttttggtgtggtcgcacatgaccactggccaagatgatttccgcaacgcgtattcctaacatggtctcgacctttagcggtcagtgggcctaacggagtttcacgcgtcttggatcgtccgatcgcatcatctgctcttcgcttgcaagttcacagcatcagctcacacggtagcattttgtctttgctcaccgtggtggctgaacttttatgatgtctgcgcttggccttctgcctggcgatatgactcgccgctcgtcataagcttccacgcaatccgcgccagcttgttggcgagcgctacggcaaccaactttggccttttccgctgcagcagccccataagccatgcagaggcgtgcctgctgcggcctgttctgacttgctgtagaagagatgtcgcgccaaccaccaagatgctccgcaacatttcgtcgccagcccgggtaatgacaccaagcctgacctttccggcagttgaatggtccttcggcgtcagaccgatccatgctgcaaagtcgcggcccgatttaaacattcgaggatccggtgtcttcatcaagagaagggaggcgcctatcgggccgacacccgggatctcggccaggcgtttgctgcattcatcagcacgatgcaacttcatcaacttttcatcgagcgttttgatctggcaagctagctcgcggtattcctgtccatgcagcgcgaagagatcctgcgccagttccggtagggacgggtcagcggcaatgcgctccaatagcgcttcgatgcggcacatgcctttggccgcaacgatgccaaattccatggcaaaaccgcgaatggcattggcgagctgtgtccgattgcggatgagtctctctcgcataccgaccagcattaacgccgcctgctgatcagccgttttcattggcacgaagcgcatggtcgggcggctcattgcctcacacaatgcttccgcatccgcggcatcgttcttgccccgtttcacatacggcttggccagttgcggtgctatcaactttacttcatggccgaacgaacttaacagccgtgcccagtgatgtgacccaccgcacgcttcaagtgcgataatggtcggcggtgttttctcgaagaacttcaccatttcccggcgcgacagcttcttacgaaggattggctgctcaaccgcattcacaccatgcaattggaagacgctctttgacgtatccataccaattcggataatctgttccacggacggtttccctcgattgagaacttcaacgaactcattctggcacattcgatgccgttgggagccgtccacctcaacatggtgcgctgatccaagggcgcggatggtctggtgccacgacgcgcccatcggcgcgtgatcttgttcttctggcctatgcgcgcttcgtcggcccaccagagttcgatgtccgtgccttgcgggagccggcttcggatttccgccagagcggcggggaagtctttttaaaagcgtctacttccagctcgttctgagcgtagtggcgtgggcgagccgacagcttggcaaagccgagcgccttcaactcgcggccgaccgtcgtctcgtccatcgagatgcggaattcctggaatatccactgaaccaggtccttgcgccgccaacggacaacaccgtggatcgccgggatcgggccgctctcgacgacctttgcaagagcctggcgctgagcggcattcaacttcgctcggccgccaggcgctttgccattcaccagtccatcggggccgcgcgcgttgaaacgcaggacccaatcccgcacaatctgcagcgtcacgctgccgatccgtgccgcatccgagcgcgggccgccgtcatagatcgcggcaagagccagcaaccgccgggcctgattggcatccttcgtctgccgtgcgagctgtcgaagagcagctccgtcgaaatcatcacgcaacaaaaccgccgaacccatcgcaaacctcctgtttgcagcatggattcagattcgcgacaccttgggaatcccatgagagtcagaaacggcgctcgttggtattacggcatgttgatccactgtttcgtcatcactattcccgagccttgcaatcgagcttggatcgccaggtgaaggcagggtctctgcgttcgtagagcgctccaggcttgatcaggacgacccagacaatccgggccatcttagcggcaagtgcgacgacgactttgtagggtgcatccgagtttgaaggccatccagccagttccccaatcgatctcttgttcggtcgagatgccgaaagcatgatcgtgcgccatgtacgagcagtttgcgcacgtagcggtttcctcgtttgctgatgccgagaagcttctgctttccgccggtcgagtattcgcgcggcaaaggcccagccacgcagctagatcgcgggctttttggacttgccgaccgttgccaatggccgcgaggagtgcagtcgcacccaaagctccgatcccggggatcgtcatgagccgtcgagccacatcctcgcgactggcgatcgcctcgatctcgtatagcgcggcgatcaggatgagacggcggcgacaatctggatgagactcttatgtcgcggtcggcatgaaggtatcatgttgattgtcgctggcaagggtctcatcgtgttctgattgtcgctccgcgacaatcagggaagcacttttggttgtcgcgaaggcggcgggtctgccgcggtggcgtttggcttccatggcggaacgtcgccgatagctttcgacgttcatttcgaagatcgttgcgtgatgaacaagtcggtccaccgcggcaagcgtcatggccgggtccggaaagacgcggttccattctccgaagggctgattggcggttatcatgatggaacgccgctcatatcttgcggagatgagttcgaacagcacgctggtttcggcctggtccttggtgacgtaggccagatcgtcgaggatgagcagatcgaacttgtcgagctttgcgatggcggattcgagctggagttcacgccgtgcgacctgaagcttctggacgaggtcggtcgtgcgcgtgaacagcacccgccaaccattctcgatcagcgcgaggccgatggcggcggcgagatggctctttccgccgcccggcggaccgaacaggaggatattggcacctttggcgagccaactgtcgccggcggcaatggccatgacctgggccttggagaccatgggcacggcgtcgaaagcgaagctctcgagcgtctttccgggcggcagatgcgcctcggcgaggtgacgttcgatcctgcgatgcgcccgttcagccagttcatgctcggcgatggccgaaaggaaacgagccgcaggccacccttcacgatcggcctgttcggcaaattgcggccacagcgttttgatcgtcggcagcctcaggtcattgagcatgatgccgaggcgggcttcgtcgatggtgttgtggacgtttttcatgcggcctctcccgcataagcagaccccatcagggcttcatagctattgagcgatgcgagctgcacatgcacggtcggcaactgatccgggtccggaccgaagatggctctcaaggccatcaggtcgggcagtttgcgggcgtcgagcgttctggcaagctcctcggccagttcacgctcgcaaccgcgatcatgagccagggccagcaattcgacggtgatcttgcaagcctgccggtcaggcagttgctcgatgagagcgtcgaaagccctgcgatattccggccgggggaagagcttgtcgcgatagaccaggttgagaagcgccatgggctttttgcgcagagagtggatgacgtggtgatagttgacgacctggtcatgcttgccgctcgcgtgggcgcgacctcgtggcaacgtcagcagatgcgtgccgccgatgaagacgtcgagacgatcgtcaaacaaacgcacacgcagccgatggccgatcaaacgggaggggacggtgtagaagactttgcgcaaggcgaagccgccggtgcgcgacacggtgacgactacctcctcgaagtcggtggtgcggcgctcgggaagcacctgcagatgcgggcgctcggcatcaatgcgcttgccatgcgcggcattgcggcggctgacgatctcgtcgatgaaggcgcggtaggagcgcagatcgtcgaagtctctggtgccgcgcatcaggagtgcatcgcggactgcgttcttgagatggccgtgggagctttcgattgagccgttctcgtgggcgacgcccttgttgttgcgcgtcggcgtcatccggtagtgagcgcacagctcctcatagcggtttgtcagatcgaccttggcatcggcatcgaggttgcggaaggcagccgacaggctgtcgctgcggtgatagagcggcgaaccgccgaccgaccacagggcgttctgcaggccctccgccaaggcgacgaagctttcgccgccaaggatgacatgggcgtgctcaaaacccgaccaaaccagccggaagtgatagagcagatggtcgagcggttggccggcgatcgtcacgctgaggctgcccatgtcggtaaaatccgacagccctagtcggccgggctcgtgcgtctggcggaagatcacctcctgtgcttcaccgtgaaccgcccgccatgaccggatgcgccgctcaagtgtgcggcgaatgccttcgggcagttccggatgacgccgcagcatctcgtcgtaaacggcgaccgcacgaatgccgggagcggccttgaggagcggaacgacctccgcatcaaagatatgctcaagcggatcgggtcgacgccgaccgcggggcggcttgttctgcgacggaaggcgctgctctttctccatgcggaacgccgtcgcccggctgatcgacgccttcgcggcggcgacctcaacagaatgcgtttgtcggtacttcatgaataatctcatctgatgatcggttacatggcgacccggcacaaaggtggttctccattccagaaaaccgccaccgtagcgggccgaccgcgatcatgagacgcctaaaaattgcgccgcggcgggggtgtaactccggtcgggctacgccctcccttcgtcacacccccaccgccgagtctcatcctgattgacgctgagtctcaccttgtttgtcgccgcgcaatctcgcgtgtgacgtcaccaatgcgcttctccaattggcgcagatcggtgaacagctctgcgagcagcttacgcatcgccgacgaaaggtcgttttgattggtcctcgagaaccagtggcaggtcgagcttgaacagacctgcgccctggcgtagggcgaccccgtgttcgaggcagaaggctcgcatctgattgatcagacgcgttctcgttccgatcatctggccccgcacccgatgcaaagcccgaagatcggcttgttcctcgctcttgagtgcagcaaatcgcatcgttggtcgcgtggctgcctcagcgatcgcctccgcatcgatgatatcggttttgttcgactttacgtagggcttcacaaactgcgcggggatcaagcgcaccttgtgtccgagcgcctgtatcttcctggcaatccaccgagatcctgcgcacgattccatccccacgatcgccggtgctgcgcgcgcgaagaactgtaacagcgtgtcgcgtcggaaaccaaccttctggactggcacgccatcgctccgaggccgacgacgtggaatatactcttgccgatatcaattccgtagacagccgctgggcgcggcagattgcgttgtggtattgcaacctccttcggtttgacagcctcagaatgcggcaggaggacaaggcggaccatcccattaatggtagggcctgccgccaagcgtgaagccggcgcgcatctgaaggccgtcatgggtctgtcggagcggcgggcctgccagatcatatccgctgaccagaaaatggtgcgctatcggtcacgccctataacttgaaccgcccgcacacggtcctcaacggcttgaccccaaggagcagaaggctggcgcgaaggtggcccgacctctgcagcatgggatttcagaagcaacctttacaactggaaagccaaatacggcggcatggtgctttccaaggcgaagcggtctcttggccttagcctttcgtcttggcccgctagggacggcgtgccctaggatgaagatcgtcccctcgcacttgtgttcagctttgtccgtttgagacttccatgtgcgaaaccccagagactgagggcgggtattccgtcggcgtggcgcgaaaaaacgtaagttttctccccttgttctcattcgttggcacgccgattgcattggactccgtgtaagcgcgtgggatgagaccaactgttaccctcgattagcgaccaaattcgagcaaatgagagtgacagttaccagacaaccaaggagtagctcatgcgaatagccgtcgtgtgtaacagtgcttttacgggtgtaatcaatcggttcggtcagccttatccgcagccgccgcagccttggccgcagggccggatagcggacagcgtggtggcggccctgcaagaatgcggccacgagacgctgctgtgtgaaggcgacaaaggactgctcactacgcttgagcggttcatgccacccgatccgctagcccgtacttcgggaatggtcttcaacttggccgagggaattcagggcgagtaccgtttcacccatgttccggctatgctcgagatggccggcgtcccctacaccggatcgagccctctggggcatgggctgaccgacgataaggtcatcagcaagacgcttatgcgcgatagcggcgtgcccacgccgaactttagtattatgcgccgcggcaccgagagtaccgacgatctccgattcccagtcgtggtgaaaccgcgtcacgaggacaacagcttcggattgcagctcgtacatgagccggctcaattgcagcaagcagtgaaaatgatcgtcacgaagtatgcgcaggatgcgcttgtggaagaatacatcgatgggcgagaaatccacgtcgcgctgttgggaaaccaagaagtcgaggtgttgcctatggtggaatttgagcttggcgaacacgaagcccctcttctaacctgggaagcgaagtacttggcggccgtgcagccgccaaagacctgtccggcgaaaatcgagagcaagctcgcgactttgctgcgggatatttctgttgcgaccttccgcgcctgccagtgccgggattatgctcgcgtcgacctccggctcgaccgttccggccagccctttgttcttgagataaactcgatgccgggactcagtactcactccgcttatgttttagccgcgatgactgccggacacagttactctagcttgatcaatggcatcctcgacgtcgcccataggcggtacttcggaaacggcatcctagggtgagggtggttcagtcatcatagcccaaagatggcggcaactgcgatacagatttccgaaaaaggtttaggcgtatcggtcgcagcagctgtcaatctgatccacgcattagcgagtgtcatacaggaatgatagctgcatgcggctcggtacggcggatgccccttgtctcgatgctcttgtcccgatcaagccggaaagcatggatgaagtcgacggctaagagttcatgaacgtcgccgcggtcgcggtcgcgcacaaaacgacacgcgccgtaggaacagtgcgggtttgcgaggagaggtgaatgtgacgacaaaccggtatggtgcggtttgggaaacaccgatgagacgatgcaaaagagctcgtccgtttgactggcctccgatcgcgaataccatcaaggcctgcggtcaagcagctcgcacaaacatgccggaaactgaccgcaagcaccgtgtctgccgtgatgttcaaattacacctgtaaacatggagagattcacactcgtccctatgcccgatggtcgtgcggtggcttgccacgtacgggccccggctgccgcggctcatatttcgccgagcgctctcgcgtctcttgcactgccaaaaaccgttcagcccggcggaacaattctcgcccgtcgttgaatcaaaaagctagcccagaacaccaaggaagaaatatggagaagtgctcacacgagagcggtcgtcattcggcggagaatgacggcaaatacgatatcactggttcgacggcgacgaacgtcgtggacggtttcacaatggtggcagttggcgacgttatcgtgtcgcgaaccctggcgaacgggcaccatccgggctttagtgagatcgtcgagctcctgcgagccgcagacgtaactttcggcaacatggagacgctgatcttcgacatcagatcattcaatggaacaccgcaggctgagtacgggggggcgtatcacgtcagccttcccgagattggacctgatctgaaggcgatggggttcaatattatgggccgcgcaaacaaccattccttggactggggcgtcgaaggcatgcgtgagacgagccggatcctcgatgagagcggcatcatccacgccggtgtgggtgaaagtcgcgcacaagccagcgctgcacgtcttttagaaacggcccgcggtcgcgtcgctttgctctcatgcgccacctcattcacgccgatgtcgcgtgcatgcgatccagcgggcgaggcaccagccaggcctggagtcaatgcgctccgtctagagagaagcgtcgtcgtcgagcccgacatgcttgagagcctaagaaagatacgtgatgccttgcccaatcctgggcctaaacacgatgatcgcgaaatgttggtgctcgcaggaacgacctatagaaccggcaaagacgtcggctacacctatgcggctaatacgcgagatctggccgatattttaagaaacgttcggcgcggcaagcaatattccgatttctgcatttttacaaaccacgcacacgagccgggaaattggagcgaagagccggccgattttgagcaggcgcttgctcgcaagctaatcgatgcgggagcggacgcgtacgttggacacggaccgcaccgactgcgtggcatcgaaatctacaaacgccggcccatcttctatagtctggggaacttcttttatgatgacctccggacacccgttggggcggacatgtacgatgtgtacgacaaggacccacaggtggacaccgatgccgaagtaaccgcagcggaagaaacaatgggttaccctacggctgcagggttcataggcgcgctcgccgaaccggtgtattacgagagcgtcgtcgcagttagccgctttgaggagaaccaactggccgaactgcggctttatccaatcgagctcggttattccaaaaggcttgcgaacaggggcgtccctagtcttgctccacgccctcaggcaatctcgattcttgaacgcctgcagaggttgtcagagccgtttggaacgagaatcaccatcgaggaccgtgtcggtcttattagactgtaaccacgcatcgtcacgaacctcccaagctgcgatttctcgcccgtatggggtcgctcttatcggctgagcagggaactgataacagatggctcaaggaaagcgatgttccaagccggtttcagttgacttgtagaactgatccctgcttatcctcgttcgtgtagaaggaatgagggagcggtttggtgtcgctgtctgagagcgagctacatgccaagcgtgcagttgctgatgcggtaccgtaatctcatccgtaaacgccatgatctgccggctcagaatatccagcgaagtgcgtgcataagcccaggccgttggcatcggacagcggttgctgcgactttgccagattagatagcgccgggattggccacaagaccagattctgccaatgcgcccgcagcgcatgtgcgaccatggtgcgctggcgaacgagcaacgctcgcgcgcggtggatcacgagaatgccttgctgctccaccgtcgtcacaggcacgaaccgcatcgtcgggagccgcacagcttcgcagattgcttcggcgtccagctcgctcttgccacgcttgacacaggcatcacataggagagcgggacgctcgtgcccatcgccgcgagcgtgcgaggccaatgatgcgctgttccgcgcgcttccatcccgatcaggcatgatggtagcttcgagaagaagggcagcatttgcgtgtccctccggcggggaccgacttgcgaagttccgcgtctcccgtgagtctgcgctcttaagagtggacttaagagcgcactgagcaattcatgggacatgcagtttgctgacggggccagagcggcgtcggcgatggtcgttggaagatcgcgcgcagatactggcggaggccttcgcgccgggcgcggtggtttccgaagttgcgcgccgcttcgaggtttcgactggcctgatctacacatggcggcggcaagctttggtccagcaggccgagcccgccctttgtgccagccaagcttgttgactctggcagcagtgatgcggtcgaactggccatggcagtggagttcccgaacggcgtgaaggtgagaattggctcagcggctccatgcgacctggcagccgcgatcatgcgagcgctcaaatgatcaggccgcctcgcgcggtggcgccgacttcatccttgcgctaaatgcaggtcgtttgcgcagcatgggtgccccgtcgatcttctccctgttggctctccgcaacagcaacgatttcgtcctcgatttcgcccgatcggagatcctacccttcgccaaggtcccgatcttcttcggcgccagtgccttcgacccccgctcctcggttgaagctgaactggggaggatcgcggaagccggcttcggtgctgtcgtcaacttcccgactgcgatcttcctcaacggtcgctttagggccgatatagagtgcgccggactgggttttcagcgtgagctcgaaatgctccgcgttgcccaagagcgcggcatggcgacactcgcgtatgtctgcagcatgactgaagcagagcaggcggcagaggctggcgtggacatcatcaatcttaatctcggctggaacgtcggcggatccgtcggaagccgcagcgggcttggtctggcacaggcggccgagtacgccaagatcgtgttccggcagataaggggaatttcccaggagatactgtgcctgctcgggggcggcccgatcgttagccccgatcagatgtacgaggcctcgatcgtcgccaaggcagacggttatatcggcggctcgaccatcgaccgggtgccgctcgaagcctcgatggaacggatcacatcagcctttaaatctgttggcaccttgcaaaagcgcatcgatgagctggagcgaaagctcgagcacgtgcagcgggagtatttgactgtcgggcgctcgccgttgatccaccagatcaagcagcggattgaaaagctcgcagcctcgcccctgtcggtcatgattaccggaaccaggaaccggaaagaagctgctcacacgcgccattcatgaagctgccagacgtcctggcagcaaattaatcaacgcgcctacggcggatgttattggcgagtcgctcttcggttcggccccggcgcagggtggacgcgaggtgctcgggctgctccaattccatcccaaggcgacgctggtgattgaggatttcgaaactttgtgcgaagacgctcagaagcggctgaccgaggtcatcgagactggcgtttaccggcggcttggtgataacgacagaggttttcgagggacgtctgatcctgacatcgatgcagccgctgtcacaacttagctcaagcgggaaggtaatctcctcgctcgcttcgcgcctggttcccgggcatgtcttcctgcccaagctacgcgaccgcctggaagacctgcctctgcttgcggagcacttcctgcaggcgctcagaaaggatcggcgcagcctcaagctgtcggtcgattactcggcctaccgccttctgatggcctattcctggccagaaaacgtccgcgaactgcgctccgtgctcgagacagccgccatccgctgcgagggcgattggatcaaggcggagaatttgccgcccttggaccacgcggatatgcgtgaatcgcacccggcaaacgagcgcgaatggatcctggacgcgctccagcgtcatcgcttccgccgcggtgaagccgctcgccatctcgggatttcgcgcaagacgctgtacaacaaaatgcgcgcctatggtctgccattgcagccacgggacagcccttaagctacggccaagcgaccacgccgactgtctattgcggataaggcggcagcaagccatgacaccgcatctcagatgatgtggtctgccaacagcagatgccaacaatgacgcggcgtgctccgaatcccccggaaaaggacgttcccccgcttccgaaaacggcgactggtttagcaaaaaatggcgtaaggaagcataatttctgcgagcgctccctcgataacgcacgatcacgcctttaattcgaatctagtctcacacaccgattgcttcggatggggggacgaatgccgctgttgaatgtatcgccattgaagtggccgataagtctaaagattccggctatgaccgtctgcgtagcggtactgtcctgcacgacggtcgcgacattcgcgggaattacttcagtcgcaacaaccaggagcttgatcgagaagcaccttaattatgtcgctatctcgatgcgagacgcgctcctcacaaaactccaggcgaccaagttcgaagtcgaagggctctccgccaatcctgggctgcttcaactctttaataatacgagtgttggtttcgcggcggtgtcgccaacagacctcacggcagcgtcggtagataaagtcgagagtgggaagtttagtctcgcggcaacaccaaccacgaaattctatgtcgacaattatcaaaagctggatgcttggctcaagccgttggccgccaagcagtcatattcggggatccttttagcaaatgctgagggcgcaatcatctatagcaccggaactaatccggtcggccccgtagatgccaacggatcgatcaacttggccatcgcaagctcagctaacagtcaggaggcggtgatgactgatttcacgcctccaacgttgtccgcaccggggcaggctctatatgccgttgcgatcgttcacccgttcatacctgacaaacgaaatggtactctactgatttccatgagtaccgaaatgctaaatgcagtcatgggtcaagcaaagggtttcggcccacacagcgaagcgctcattgccgggagcgacggcaaacctcgctccttgtcgtccatatccagagacgaagacgctgaagcggtcgtcaacagtgacctgctctcccaaggtataaagacgtccaatttcggcgctcaagaggttctttctgcatcacaacaactgaaatggcaggatcaccagtggtcgatcattgccctagagccggaggcagatgttgtctcggcgtcaactgcaatgttgatcaagattatcggcattacggctgccactgcgattctggcgctggcaatggccatcctcgcctctcgctcaatatcagggccactggcggggctggtgtctattatgaaaagactcgcaaacggtgacataaacgtgcgtgtcgctggtgtcgatcgccgcgacgagatgggcgaaatgtctagagcagttctcgtctttcgagataacgcgatagctagggttgctgcggaggacgatgcaaggagcgctgaagaggcgatggagcacgaccgcaggatgatggagatggagcggtcagagcggctcgacgagcaagcccgagttatggctcaaattggcggaggcttagcagcactctccgatggagtgtttagtagacccatcaccgtggatttcccagaagagtatcgtccgctcaagagcgatttcaaccgcgcactagggcaactcagagagacaatacgaactgtcgcggctcaagccgcgtcgatgtcgtctatcgtctccgaaataagctgcgcaactgatgtcctggcgaaacggacggaacatcaggctatcgtgctcgatggtgccgtgaatacgatggatgcaatatcaaacgatgtaagcgtcacagcgaacgcggcaaataatgctgatgcgcttgtccgcgacgcccactccgctgcagccgcgtcggacgagattgtttcgagcgcaatagcgggcatgttggagatcgaagagtcttctgcaaagattgcaacgatcgtctcggtcatcgaggagattgcacatcaaacgaaccttttagcactcaacgctggtgttgaagcatccagagcgggggaagccgggaaaggattcgcggtcgttgcttcggaggtccgggcgctcgcacagcgatcctctgacgccgccaaggaaattaaggacttgatcaatgtttctacccaacgtgtggagcgcggcaaagagcttgtcgatagcgcgagtgaattgctcaagcatatagccgcgcgtgtcgatctgatcaggaccacggtttccaacattgctgcaacggcaacgagccaagcaaagcatctgtctgaatttcagactacgatcgctgagattgatcaatctactcagcagacagcggcgatggccgaggaatcggacgccgcttgtcgatccttgaacgccgaggcgcagcatctgttggaactaattcaacaattcgaactgggagggggttcttccacccgacagcctcaaagcccgcccacacagagatacttcatgtcgaggtagtcttccagcccatgcctggacccctcccggccaatacccgattgcttgacgcccccgaagggcgcggcctcggatgacatccggccggtgttgatcccgaccatgccatattccagcgcttctgccacccgccaaacccgcttcaggttggaggcgtagaagtaagctgccagaccatagatcgtgtcattcgcctcgcgcacaacgtgatctgcatcatcgaaccgtaacagaggtgcaagcggtccgaaggtctcttcctcagccagacgcatcgttttagaaacatccgtgacgaccgtcggttcgaagaacgtgccggatgatccagttcgacggccgccactgcgaacccttgcgcccttctggacggcatcgctgatgtggagttcaatctttttgagagcctcttgattgatcaatggaccgatcgccacattcggatcaaagccgtcaccgaccttcagagtgcgcacccgctcggtgaacttttcggcgaactcggcatagacgccggattgaacataaatccggttggcagacacgcaggtctgtcccgcattgcggaattttgcctgaatcgctccgtcgaccgcggcgtcgatgtcggcatcgtcgaagacgataaagggggcgttgccaccgagttcgaagctgatcctcttgatctggtcggagcactgacgcatcagcaaccggccgacctcggtcgagcctgtgaagctgatcttccggaccttcggattggtgcagagttcgcggccgatcgcgtccccctccgacgcatagaccaggttcaggacgccgtccggaaaaccggccagttttgccaatgcaaacatcgcgcctgcgaccagaggcgtctgctcggcgggcttgagcacgacggtacagcctgccgcaagcgccggcgaaatcttgcgcgccaccatcgaggcgggaaagttccagggtgtgatggcgccgacgacgccgatcggctgtttgatcaccagcatgcgccggtcggtcgatggcgccgagatggtttcgccatagatgcggttcgcctcttccgcataccattgaagataggctgccgcatgctgcacttcggatttcgcctcgccaagcggcttgcccatttcggcggtcaggatggctgcgaggtcatcgctgtgttcaagaatgaaccggtgccatttccagaggatatccgatcgcgcccgcgcggtcagtcccgaccacggttcctgtgcggcatcagccctttcgatggccgcgtgggcatcggcagcacccatatccggcacttcggccagcaattcgccggtggatgggttaaacacggagaaccgttgccgctggccagcgaccgaagggtgcggttcattggcaaggttgcgaaaaagctcgggacatttcaggtgccgcgtcaatgccgatgtcagtgtcattcttcgttcctcccacgcgcgttcgattgcgcctcttcccgcctgtcgcgaaaggcaaagccggagcaatgatcgccattgcgccggctcgtcccttggactgctctctccgttaagtcagagagatgacggcttcaatctcgaccttggcaccttttggcagcgccttgacttcatagcaggcgcgcgccgggtagggggtggagaagaagcccgtgtaaacgcgattgatgtccgcgaagtcgccaaggtcggtgagcagcactgtcgtcttgaccgtcttcgacagatccgtgccggcggccctggcgatcgcctgaaggttcttgaggcattgttcggcctgttcgacagcattggccgaattgaactccccggtggccggatcgattggcaactgcccggagacgaaaagcagatcgccaaccttgatggcctgggagtaggggccgaccgcgccgggggcatcgtttgtagaaatgggttcgatcaaagttttagtcctccattggtatccagtgagtgctcaagcgtagcggctgacggcgaggtcggtggcgtcgatctcgggcttccggccagataccaggtccgcaatgacgcgggcagagccggagctcatcgtccagccaagcgtgccgtgcccggtgttaaggaagagaccggcgatcttcgttgggccgatgacgggcgtgccgtccggcgtcattgggcgcagacccgaccaataggatgcttcttttgcatcgccgccgggaaagaggtccatgacggaatgctcgagtgtgcgtcgccgggcggggccgagatcattggtgtatccggaaatttctgccatgccgccgacgcggatgcggtcgccaaggcgcgtgatggcgatcttgtacgtctcgtccatgatggtcgattccggcgcccgcgaggcatcggtgatcgggatcgtcagcgaatagcctttgaccgggtagaccggcagcttgatgccgtgacgcttcagcagtagcggcgaatagctgccgagtgcgacgacaacagcatcggccgcgagcctttcccagttggttacgacacccctgaccttgtcgccctcgacatccagtttcctgacttccgtgccccaggagaagcggacgcccaattgctccgccttcttcgcaagcgcgttggtgaacttgaagcagtcgccggtctcgtccttcggcgtcagcagcccaccgacgatcttgtcgcgcgcgggtcagcaacgcgaagctcgccgtggaagttgggctttcgccgtcagcctgcctgaggcgtatcaagcttatggagcaggcaggtgtcatcaggggctatacggcgcttgtcgatccgacgcagtcggaatcgaccatagccgtcatcatcaacattacgctggagcggcagacggaggagtacctcgacaagtttgaagcggccgtgcgcaagcaccccgaaattagggagtgctatctaatgaccggcggatcagactacatgctgagggtggacgtcgagaatgccggggcattcgagcgcatacacaaagaggtcctgtcgacgttgcctggggtgctgcgtatccattcgagcttctcgattagaaatgtgttagcgggccgtctgaaagcaaaaagatgaaacttgcccatttgagagattgcgcggcagtgaggtaggctgtgtacctcatatgaccgctgcccctcaagatccgcaggggctacaggccacagaagatgtgagctcagcaatcgaaggcactaggtcgtggtgacgatttaacggattgagattcccaagaaggggcaaatcagattcaacactgacttttggaggtcagtgatggattgcgatgggcttcgggacgatcaatgggaacgtatcagaggttttgtgcccgggggcacgaagggcaagcgtggcccgcgcacgaacaaccggctgtttctggatgcgctgctgtggatggcccgttcgggcggccgctggcgagacctgccagaacgactgggtgactaccgcgccgtaaaacgacgctattaccgctggatcgagatgggcgtgctcgacgagatgcttgccgtgcttgcccgcgaagctgatttggaatggttgatgatcgattcgactatcgtgcgcgcccatcagcatgcggccggggcgcgcagggctaaaggggggcggatgcccagggcttgggtcggtctcgaggcgggctgagcaccaaaatccatgctgccggcgatgcgctcggcctgccgcttcgcctcatcggcacggcgggacagcgcaacgacatcacagccgcccatgatctcgtcgacggtctccacgccgatgccctgctggccgacaagggctacgatgccggacatctcattgagaaactggagaaaacaggaactgaaatcgtcatcccgcccaaacgggatcgcaaaatgcaaagggcctacgacgccgcactctataaagaacgcaaccgcatcgagcgcttcttcaacaagctcaaacagttccgccgcgtcgcgacacgctatgacaagttgctcgccaacttcatgggctttgtcaaactcgccgctatcgccatatggctcaaatagttaaatcgtcactacgacctagcgggcctatgcgctatcttcccgtcgcgtcacgacgggaagaatggcttgaaacgcgattcttaattgacggctgcatggctgcttgccaattcgccagccgggtcgacaacagcggacggccccctccgcggcggttgacccggaaggttgtcgcgaggcggcatcgagacgatcgccgcgcccacatcaatggcgtcgatctcccgacgccttctttatttctttgccgccgagcaatagcttgagcctcgctttcgcgtcggtgtgtgccaagcgttggaagctttggcccgaggggtttcaacgtccgctttgtcccagccggtggagaatccatgccatgcgaaacgcggcttcttctgctactcctggtccatgtgacacacccatatggccgccgatcatccgagtgcggaagattaggtccggatcacgatcaacggcctttgatcggcgctgcgcaacatagcgagcgggctgatagtagagcacctgactgtcgtggagggccgcgtcgatgtatgtcggcggataccgtcgatcaggcgtcagattatagtaagggtcatagcttcgtagatattgatagtcgttagcaagatgcggatctccatactctgcagtttctcttagggcgtatgggagcgtgaagtccaactccgtgtcgatgatatcggcaagtggaacctcggcgagcacagctcgaaaaaggtcagggcgcaggacagcggcggccagaaccgtaccgccgccagcgctcctgccctcgatgacaatgccgtcacggctggcgaaccgatgctcgacgaggcactcggccgcagcgatcaagtccgtgtgcgtcagtcgcttttgatcgcgggtcgccgcttcgtgccacgcccgaccgagttcgccgcctcctcgcacgtgcacgatgccaaaggctaccccgcgatcgagtaggctcaagcgagcggtcattgatgaaggccagccaaagaaagccggtaagctttgtgctccgtagcagccatacacgttcagcaaaaccggaccgtcttcacctctatctcgccgcgctactatcgagattggaacctccactccgtcctctgccttcgccattacgaccctagcctcgtacagttctggttcgaaacctgataccagggttcggtagaggactttggacttatccgttaggaggtcgtgttggatgaatatgtcaggcgtcacaaaagaacagattttgtaggtcagcgcagagacccggtaaggatgtcgtgcgcaggagtagctgccgcctgccgatagaccaacggtcacggtgcagctatgttcgacggggacgatactgggcccgactcgtccatttcggtggtgcgcgactaagcgaggttgaatcccttcgcgctctaacacaatcacatgctcttcaaggacatgaatctcctcgagcgttatgccggcccgatgtggaaccacttcctgccagcgcgacggtgaggtgtcatcaatcgccgtgcgcacgaggcgcaaattcgggccagtgtcgttaactcgaaaaagaaactcgttgccccagtgttccgcgtagatctcgtgccccagttcacgtgcaaggatccggcgccacatgtctgtcggtcgttcggcaggaagacaccatacctccgcggcggcgcgctggatgcgagaagacatgtccgaggtgatgatcacgtctatgaacaggtaagcgccgctgcccgaccgccgaaccaccagggccagtcgctcattcacttcttcgaacaccacctcggaacgtccggtctcgacgtccaatcgaacaacacggtcgtgttggcgccgatcggcgcgctcgcgcgtaaagaagagcgtgcgattgtccgctgcccaaactagtcgcccagcgcgggaggggtcgcgccagatctcgcggccgttggtcatgtccctcactctcaattcgtagcgctcgttaccgatgaggtcgaagctgaatgctatgtagcgaccgtcatcgctcggttcgagcgcgccgagagaatagaacacttctgccccagggagcgtgttcggatcgaagacaagctcttctggacctccagttaccggccggcgccaccatgctgaatgtagcaagccgctttgacttttctggaaatagaaaaaaaagccgacttggaacggtggtggtgcgccatcgcaagaatctcgcttctcgatttcggcgattagatcggctttgagttctgctacataggacgtcacttcatccgcgtaatggttctcggcttctaaatatgcgaggacatcaggatcttccctgtcgcgcagccagccgtaggagtcgatcgtgacgtcgttatgaagcactcgaatccggcgttcgcttcggggaagcgggggctgcagggacttattttccatcagaatgctcctggaattggattgcagacatagcgttttgcagggctgagccaaagccgacggttgccgagcaacaacgggaagaactctgaggcgtcggaaggcgatgggtccaggaagttgagccaacgctccgtgttcgcgaaccggtcaattcccctgtgtggcaagccgaccccgcggaggcgcacctcaagctccccaccaatggttgcagaacagcttgcgacaggcacggctcacttctccgggtttatacgtcagtcccagctagaaaggcttctgcggccaagacgaagtaagaagcttaagcccagggccacacaataattcggaaacgaaggcgcttttgggcgcaatgtaggtgagcacgacggaatcctgcaaagtttcgcccgctcgcgctttaatgcggcgaggcgcggctgtctcaacgccagatgcggaatatcatcctccgattggactgcgtgagcaaaatttccgcgtcgtgggactggaaaagtccatggacgtgcaggattgctgcgagatgagcctttaaacacccgaagcctgcaattcttgcgagtctttgcaggatcactgcagagccgcgccgatacaatcgggcgatggaccacgattcatctcaaaacaggggagcaccaaatggtcgacgtgtacagcgaagtcatcaaattctttggcgtacgtccgaaaggcgctgcactagcgagtgccgccgtgtgcctactcgtctgggctagtgcggcagaagcggtgaccctcgaggaagttaaggcacgagggtacattcgaattgcgatcgccaacgagattccagccagctacacagatgctaacggcgacgttaaggggcgagaagcggaagtggtccaacatgtccttgaacgcatgtgcgcgcttcgcaaaaactggacattgattccgctaaatcccggacagcaatttcattaaagtccggacagtttgatgcggttggtcctcggcagcctggttagcatcagggctgattgatttcgccgttttctgccccagtcaagaggggtgcgcttttttgctttcgcatgctctcgccccggagggtgatgcggtgagcattgtggacgatacggtcgagtatggcgtcggcgaccgtgctgtcggcaataaggtcgtgccagcttgccacgggaacctgagctgtgatcagggtggactttcgctgataacgctcctcgacgatttcgaagaggtgaaagcgctgctgatcggagagcgtatgggttccaaagtcatcgaggatgaggagctggacgcgggtgagcctgtcgatgaggcgggggaaggagccgtcgaggcgggcaagcgcgagctcctcgaacattcggggcacgcgcacatagagcacggagtgaccgagcctggccgcttgcctgccgaaggcacaggccagccatgacttgccggtgccggtgtggccggtgatgatcaggccctcgtgggcggtgagccattgcccctgggcgagcgccatggtgttgcgccggtcgagaccgcgggcggcggcgaagtcgatatcttcgatacaggcctgggcaaagcgtagcttggcggaggcgagccggttacggatgcgcttgtcggcgcgcagggtgacttcgcggtcgagcatcagtccgagccactcatcgcggctgagctcattggtgccggactgctcggtcaattcgcgccaggcggcggccatgcccgtcagcccgagggcctgcatctggtcgagggtggggttcgtcagcattcttgcttccttcactggtagtaggatcggccacggatattggtatgcgcaggcgtgggggccgcgtgttcagcctgcggtctttcccggtcgaggccggatttgaggatggaggcgacggaggaataggtgatggcattaatggtgagcgcccgctcacaggccgcctcgaggcgctgggatccatagcgcggcgccagcgacagaatgcccatggccgagcggtatccctgttccggatgcggcctgtcgcgcatcatgcgttcgaccaggatggcggcattggggccgatctgggtcgcacggccgatcagattggccggcgtggtgttggcatagcgctgatgcgccttgggcatatggtcgttgacggtgacgtggccggaacgctgggagcggcgaacatggctggcgacacgctggtggtcgtggaagatctcgaccacccggtgggtgagccgcacctggagggtgcatccgatcagccgatgcggcaccgagtagaaggtcttgtcgacctcgacatgatagtccggatggaccttcgccgacttccattccgcatattcgaacggtatcgccggcaagggcttcaaggctggccgctcgatctcctcgaacagctcgcggcggcttttgccgacatggcgcatcgtccggttgttcaggtcctcgagcaattcggcaatcgccgtgttgagggcggcaagcgagaagaaggtacggttcctgagccgggccagaatccagcgttccacgatcaataccgcgccttcgacccggcctttgtcgcgcggtttcctgctgcgggtcggcaggatcgtggtgtcgtaatgctccgccatggcggcgaacgtcgcagtcaatgtcggctcgaaccaaagggccttggccacccccgatttgaggttgtcgcacacgattgccttggtgaccccaccatagaaggtcagagcacgcacctgaccgtcgatccaatccggcaactgctggctaaagctggcatgggcgaaggtcaggttggaggcgcccagcaccgcgacaaagatttgggccggatggatgacaccggttgccggatcgatcaccggcaccgtcggcccggcatagtcggtctgcatcacggcgcccgccgcgtgccgattgcggaacgctacactggtgcgctgccgaaaggcggcaacctgctcgcagaaccaggtgaagccgtaaccatcaggatggctggcgcggtattcctgccatagaagcgtcagcgtcacgcctttgcgcttcagctcccgaaccaccagcgcccagtccggctcgctgagatcgcgcggcggtcgaccggctcggccgaacagccgccgctccagctttgcatcctcgtccgcgccgattggcaacggccacgaaagcccggcttcccgagatcgcagcaaataggtcgataccgagctcttgccgatcttcagccgctcggcaatctcgcgcaccgaaagaccctcttcatgggtcaggcgcagaatagtccggatatccctcactgtcgttcgtcttgcttgcttccgtctcggcatcggcccctctcaacgttgtcgtgagaggcctaaccaacaagacggcgcagccgcgaaccaacccgtcaaaccgccgccggaaactgtccgggatttagcggaatcgctgtccgggaattactgaaaactgtgtccggagattaccggaaatcctgtccggactttgccgaaacccgcacgcatggacatcaagcgtgaaaacatccaatggatcgttacgtcctttagctctttgataccaggcttacaggcaaatcgcttcgacatgacggcagctggaatggctatccgcccagaaagatgtcaaaaggtaatctatagcgagccaaccagttcctatggcgagggtctactggtcccaaaaggtaatcccaaaaatcttcactcttacgaggacattaccacgcaaggtaaagttgcgatcatggccggtgctgaccagctcagaatgatgcagaagctgggtgttgaagaaggaaatattatcaccatcgcatcgaatgcagatgctattgcagctgtctctcagggacgcgctgacgcctacgcagcatccgccactaccgccgctgatttggcaggtaagagcgataaagtcgaactcgcagcaccctttaaggatccgattattgacgggaagccccaaaggagctggggcggctatacgttcaataaagaatccggcgaccttcgcgacgcgatcaacaagtcgcttcttgagtttcaaaagactgagaaattcaaagagattcaattggcgtatggcatgacaaaggaaagcattgccgcgatcccaacgaaaaccaccgatgtcctttgttcaccgtaaagcggaagattgatgggtcgctcatccagcgacccattcctaagtccttctttcgaatacgactcgcgacagccttgtgacaaccattgtgaccgggtgcaccagcgacactgaatgggacaaaagtctacaaatgcattcagaggagcgttgcggcctcagcagaccaacacgctgttcctcgcgccaagttcgggtttcgaggtctttcaattaatggaacgcagtttcgagcgtacgggcgtcgttcctcggtgattgacagccggagaaagcgtcattatgcaggatgtctgcaattctcaagaaatcctgcaggattacgctatggaacttgatcgggcagatgtggcgctcctcaatgccgtacagaaaaataaccggctcacttccgaagaactcgccgacaaggttggcctttcacccacagcatgtcagaggagacttaaacggctccgtagcctaggtgtgatcgaagcggatgtgtccatagtgtctcccaaggctgtcggccgccccgtaacgatgattgttatggtgtcattggaacgagaacgtgccgatattgtcgacaggttcaagtcctctattcgaaatacgcgggaggtaatgattggttactacgtcacaggtgatgcggacttcatcctaatagtgacagcaaaggacatggaggaatacgaggagtttactcggaggtttttctatgagaatcacgacatcaagggctttaagaccatggtggttatggatcgagtgaaagccacatttgcagttccaatcgaaatctagtccgaaactatcgtgttcgcccgacgccatagccggcgaactcgcacaaacgtaggctggcgcgacctgctagcgcaatgacctggaggccggatgaagtgccgtcggtcaatcatctggggtagcgtgaccggccctggaaatagtagaccccttctgtgtctctaacataaaggcgcctgtccactaggacgcgatcctcgtacgccgcacgtgtcagttagaaaccagcagtacaggaggacgtccgccaatccctcgcactgtcagtcttcggactagaagcagagcgcattacaaccccatgcggggaagtccgggtggttcccgtccaaaccctgcgaaacccgcctgaattttactgatttcctgcggccgaggcagaaaaatgccgaatcctggcggccgagtgcattgatcatccccagcggcggcttcgtaagcccgctcaaaaaggggaaccaaatgacacatctaaagatctccaaaaccgcacctgctgttgctcgcttccttcctgccggccgcattgcgagtgtggctgcggccctaagtttgttcttgtcagcgcagcttgcaggtgccgtgacgctcgaggaagtgaaagcgcgcgggtacatcactatcgcaatagcgaatgagatgcccggcagctataccgacccgaacggcgaggtgaagggctctgaggccgatgttgcgcggcgcgtcctcgagaaattggggatcaaaccagagaacattcaatgggtcgtcacgacttttgggtcgttaattcccgggctgcaagccaaccgctttgacatgaccgccgccgggatggccattcgaccagagcgttgcgagaaggttatctacagtgagccgaattccagttatggcgagggaatgctggtgatcaaaggcaacccgcgaaactttcactcctatgaagacgtggctcaacaggggaagattgcgatcatggcgggcgccgatcagttgcgaatgatgcaggcattgggcgtcccaaacgagaacataataacgatcgcagcaaatgccgacgctatttcagcggtcgccaccgggcgcgccgacgcctatgcagcggcggcctcaactgcagccgaccttgccaaaaagagcgacaaagtcgaactcgccacgcctttccaagatccggtcatcgatggcaaaattcagcgcagttggggtgccttcagcttcaacaaggaatccgccgacctgcgtgacaagttcaacgaggcgctcctggagttccgcaagacggatgagttcaagcagctcttgctcgggtacggttatttgccagagtcgatcgcggcgatacccgacaagacgaccaaagagttatgctcgaattgaggcagcaagaacgattgaacgtcgaccgaaacatccgtcgacgtctctccggtgcgaacgcgccgcgtctaccttccacttaaaggcgagctatcaatggattggcacgactacctcggaccgttgggtcgtggcgcctgggtcacgatccaattcactctttactctatgttctttggggctgtctgctctttcgcgttcgggattggaaagctttccaagaacccgttcgtcaaaggcttttcaatcctctacattgagatcttccgcggaacatctctattggtccagttgttctggctctttttcgccctgccgatcgccggggacatgatgggcatcgatctgcgactttctcccgtagtggctggcgttctcgctcttagccttaacctgggggcttatggtgcggaaatcgttcgaggggcaattcaggcggtcagtcctagtcaatatgaggcagcaacggcgttgaacttcagctcgtcacaagctctctggcgcgtggcgttaccgcaagcgatcccggagatgatgccgagtttctccaatctcgcgatcgccgctttgaaagatacctcactggtatcgctcattacattgcatgacttgactttcgccgcggagcaactgcgcaatttctaccaagatagcacgaccgtatatacaatggtccttcttatgtatttcgggatagcactcgtactgtctttcttcatgcgcctcatagaatcgtcggtaacccgctggcgcggacatcggaggtagaaatgctctacggttttacatgggataccggcaacggagagttagcattcgctatttccattttgccaatgcttttgatgggattgataaccactctccaggcggcctttctgggcttcttcgtcgcatgcgtcctaggaatggtgttcgcggttttacgggggatgcgtacgagatgggtagcctggccggccgctgtcctaatcgagttcataagggacacgccattaatcgcccaattgttcttcttgtactatgtacttcctgagtatggaataatattccctgcctttttgaccggagccttggcccttggcatccagtatagcgcgtatatttccgaagtttatcggggcggaatacaggctgttgaccacgggcagcgggaagcggccaagtcgcttgatcttcctcctgcgcgcacgtttacgcacgtgatccttccgcaggccattcctcgtgtcatacccgctctcggaaattatctcgtctctattatgaaggacgttcccgttctttcggtcgttacaattgttgagatgctaaacgcggctaagatcatcggagaccagactttcaattatctcgtgccgctttctatggttggtggcatctaccttatcctaacaatcgttgcctcggcgctcgttcggatcgtcgacgtcaaccttcccaaaagaggggttcccctgagatgagtgactccatcatcgttttcgacaaggtaaaaaaggcctacggcaatttcaccgtgatcaacgaactcgatttcgaggttcgacgtggggaaaaagtatctatcattggcccttccggctccggaaagtcgactgtccttcgcatactgatgacgctcgaaggcatcaacgatggagcagtctacgtgggcggggagcctctttggcatgagctaaagaacggttctatgatgcctgcgacagaaaaacatctcaggaagatgcgcacccaactgggcatggtctttcagcagttcaatctctttccacacatgacggtgctcagaaatctcacggaggctccgcgggttgtactcggcctatcgaaagaggaagcgcgccgacgtgccgaggaacttcttgagttggtcggcctagttgatcacgcacataaatttccagctcagctttcggggggccaacagcagcgtgtggggattgccagagctttggcgatgcgaccgaagattatgctgttcgatgagccgacttccgctctagatcctgaactggtcggcgaagtccttaacgtcatccggaggctcgcggccgagcacgacctgacgatgctgatggttacacacgagatgagattcgcgcgcgaaatatccgatcgtgtctgcttcttcgacaaaggacgaatccgtgaagagggcacgccagagcaattgtttagtcagcctaaggaagagcgtacgcgcgaatttctcaaggcggttcttgacgggtgatgattggcggccggccagtgggcccatggccagcagcgtgactgcttcaatttgagatccgaactcatcccgagccggtgcattcctatctcgggtgccttcttgccgtcgcgatgatcatcgcgtttgcgtggacaagcggctccgttttggcagtactcgatcgggctggctggtctcggcgccacaggatcgacggcgacgtaggcgcctcagactcgttgtacgggtgggacggtcgagccgtttgtgaggcaacgaaatgagcttaatcgccaatccaccgtacctaaaagattcgcattccgcttgcgtcctgcgcaaacgaatggaagggccggaatctgcgtgaaacgctcaccgaacgccggaatcctgcagcatcagcacctaaatcggcaaacctgctcgtctgttgatgataatctagtttcaaacagctttattggatgagggcagcaatgaacttccgtatcaataacagtcttctaatcgaagccgagcgcgacgcggttcttgaattgcgtcacgcgatgcatcgggagccggaactttccaacaacgagtggaaaacgcagcagcgaataagagggatgcttgagcggttcggcctgaaaggggcgactgttttccataatacagggctctacatcgacatcgaagggtctgcttccggaccaaagagagcggttgctgtccgcggcgacatcgatgcccttcccatacaagaaactcgcgatgatttgccgtaccagtctcacgtggagggagtgatgcatgcttgcggccacgacctccacgcttccatcgccatgggggtggcgttggcctttcaccgaatgcgaaacaatttcgctggcaaactgcgcgtcttttttcaaccggcagaagaggctgaaccgcttggcggtcgcacggtgctcgaagagcgactccttgagggcttcgacaatgctgtgggcttccatgttaccccgtcgatacaggtgggcaaattcggcgcccgcgaaggagcagtgagcaaatcgtcggaccaattcaaggttaccgtgtctggcagtgcagcccatggctcaacaccccataatggcatcgacgcaattacgattgcggcagcttttgtcaacgaagtgcagaaggtcatttcaagggaagtgccggtcgatgatcgatcggtcatcacgataggcacaatccacggcggagaggcgactaatattatttgtccgaaggtcgtgatggagggaacaataagaacgacgaacccagaactgcgaccgctattgtcgcaacgggtgagagaaattgccgaaggcgtcgcagcacttcatcgcggaaaagccgaggtcgtcgttacatcaggtgaaccggcggtcatcaatgaccccgaaatggtgcgcctcttccgcgacgccgtgtccgatatggcgggttccgacgcgttgacgcagggcaaggccattagcgggagcgatgacttcggtttctactctcaatgcattccatcgatctatttctggttcggcagtggcgaacccgggaacgagtccggtgtgcatacccccacgttcgcggtttccgacgacgttctcatcccgacgaccgaacttgctgtgaagtattgtttcgatttgctgcatgggcagtctgcacgttgatcgacttgtatgccaggatgtttgccactgtattaggtgaatgaattgtcgaacttaagtctagaatcgatcgagcgagcgcgtgagcggatcgaagagcacgtcttccgtacccctctgacgacatcaaggtcgctaaccgaacttaccggaactcaggtcagcctcaagctcgagcactatcagcgcactggtagctttaagctgcggggtgcgacaaacgcaattcttcaactcagcccgtcggatcgggcacgtggggttattgcggcatctacgggcaatcacggacgggctctttcctacgccgcaaaagcggtcggctctcgcgccaccatctgcatgtcggatcttgttccagaaaacaaggtttccgagatccggaagcttggcgcgacagttcggatagtgggatcgtcacaagacgatgcgcaagtcgaagtcgagcggctcgtcgcggaggaaggcctcagcatgatcccgcctttcgatcacccgcatatcatcgccggccagcgaaccgtcggtcttgagatcgttgaggcgatgccggacgtcgcgatggtactgcttccactgtcgggtggcggcttggctgcaggcgttgcagcagcggtgaaggcactgcggcctcatgcgaggatcatcggtgtcactatggatcgaggcgccgcgatgaaggccagcatcgaagctgggcatccggtacaagtgaaggagtatcggagcttggctgattctttaggtggaggaatcggcatggccaacgcttggacctttcaaatgtgcagagcccttctggacgatgttgtcctcgttaatgaaggcgaaatagccgcgggaattagacatgcttatgagcatgagcgtcagatactcgagggcgccggcgctgtcggtatcgcagcgcttctctccggcaaggtggctgctcgcggaggttcagtaggagtcgttttgtcaggtcaaaacatcgacatgggcctgcatcgggaggtcattaacggagttgtcagagcgaccgaggaggattgatgcctacaatgaaaatactcactgagggggagttgaggcaaatcgtgccgctcgacctcgacgcggttaagtgcaccgaagacgctttccgcgcactcgccgtaccaaacgccgtaaaaatgccgcccattctgcgcttggacgtgcctgacagcaggggtgaagtcgatgtgaaaactgcgtatattcccggtttgggcggttttgcgattaagatcagccccggcttcttcgacaacccaaagatcggccttccgagcacaaatgggatgatggtattgctctcgagccaaacgggtttggttcaagcgcttcttttagacaatggttacctcaccgacgttcgtacggcggccgctggcgccgttgctgcaaaacatttgtcgcaacaagatgcttcggtcgcaaccatctttggagcgggcgttcaggcgagactgcaactgcgtgcgctgactctggtgaggcctatccgccaagcccgtatatgggcgcgcgatcagcttaaggcggaggcactcgtcgagcagttgaagcttgagcatagcttcgccatcagcgcgtccgatgatccacggcaagccgtttccggtgcccatatcgttgttacgacgacgcccgcagaccggccaatcctcgtagcgtcctggcttgaagctgggcagcatgtaactgcaatgggctccgacgctgagcataaaaacgaacttgatccagcggcaatcgcgcgcgcggatgtttatgtggcggatagtcttacacagacacggagactgggtgaacttcaccatgccatagaggcaggcctcatcgcgcgggacgctgcttttccggagttgggggaggtgattgcgggcgtgaaaaccggacgtacccgcgagtcagatatcactatagcagatcttacggggaccggtgtccaggacacggcaattgccacgcttgcctttcagcgcgccgaagaacgcagtgccggaagcctattcgagagctgaacaactcgcgctcctgacgcctcagccatgttgaggcgctgacttctcatctgttcacacgttaccttagtatccgccgtcctgcggacaatcatgcaactaaatgctcagaccatatcctacaggaggcagccatgccggttatcaagggaccccaagtatttcctcgcgccgaattccttaggcgactcaatgctgtgaagctggagatgggccggcttgaaatcgatgcgctcattgtcggcagttctgctgatatcacgtatctgaccggctatacggctaagtccggatatgtgccacaggctctcgtaatctcatcgaatgacgaagagcccacattcatcctgcggcgccaagacgcgcctgcggcgatccaccagacattcatggatcgggacaaagttatcgggtactctgaagccctcatcgggaaccccgataaggacggctatgacgccgtagttgacttcttgaacgaacgcgatggtgccaacaagcgcggtgttggagtgcagcttggctatctgtccgtaagatcagctgaaaagtttaagacgcgcctgccaagcgcgcgaattgttgactgcacccattcggtcgcgtggatccgcatgatcaaatccgatctcgaaatttcgatgatgcgtgatgcggccgcaatcgcagacgcaggagtccaaaaggcattcgaagtcattcgaccgggagtgcgcgaagccgacgttatggctgacgtcgcagctcaacttgcgcgggggacaaacggtaaagcgggaacagatctcgcgtcgatgtatttctgttcttcaccccgaaccggcacatgccacattcgatggagtgaagatgtcatccgcgatggttctcagatcaatcttgaaatcgcgggcgttcgtcacggctatgtctcagcaataatgcggactttctccgtaggtgccccatccgatcgacttcgacgcattcatgacgcggaggtactgggtttggaggccgcgctcagtacggtaaagcctggcgctacttgtagcgacgtcgcaaacgcattctaccgcacgatcgaaaagtccggctttcaaaaggactcccgctgcggatatgcgatcgggatcgactggagcgaaccaactgcaagcctgaaggatggtgatatgaccaaactcaagccaaatatgaccttccacctgatgctcggcaattggattgaagaagattttggctacgtactcagtgagaccttccgtgtcaccgaagccggctgcgaagtgctgacgaagtcgccgcggcaactgtgtgtgatctaaagaaggcagccaacgaaagttggtttctaacaacgtgacccacttcgataatcagacgcaaattggctggttcggccgcggagaagcgtcaattctcaaaccgtcagcagggagccttagcgtcgttggacgcgagcgctctcgaagcgtcaaggaaccaaaatgcgtattcttcatttctcggacgctgagtatcagcagcggatgctccgagtaaaacagcggatgcaagctcaagacatcgatgtcttgattgtcactgagccggccaacatcaactatctcactggatacgatgcttggtccttctatacggttcaggcactgttggtgttccaagacgttgatttaccgatgtggattggcagatcaatagataagcaatccgcaattgttacaacaaatcttcctgatgaacggattataccatatccggacatatatgttcattccccagatcggcacgccgcgcaatttattgcgcaaatgctgttaagggaggctccgcgtgccaagactgtcggcgtggaaatgggcgcttattattatacagcgcgtgatcatgctgaactgcagaaggcattgccaaatgtcgcgttcaaggacgcagagttgctcgtaaattgggtgcgcttcatcaagagcgagcgggaaatcgcttacatgcgagaagccggcgtgattactgaacgcatgatgaaacgggcggtagaagtcgcagcgccaggtgtacgacagtgtgacgtggccgctgcaatctaccatgcacaaatgtcgggcacagagaactatggcgggcttcctgccaccagcccaccacacatggggttcggtgagcgcgctagggagccgcacccgatatttaccgatcgacgtatcgacacaaattctgttgccaatatcgaattgtcgggatgccgacttcgatatcacgcacccatgagcaggacagtctatttcggcaggccgccccagagttaccgggacttagcgtcctatgtgattgaggccgtcgaaacgtcactcgatgctgtccgacctggtgtgacgtgcgaaggcatcgaattagcgtggcgcaagagcatgagcgctcatggcatcgagaaggaaaaccggctgggttactccattggcattgcctacacaccgacatggggcgagcgaacggcgagcataaggcggacggatcttactgttcttgagcctggggcggcatttcacctcatgggtggattgtggttggcaaacaccggaataacgatcacgcagtctttcgttgtaacagcaacgggtcacgaaccccttacggctacgcctcgggaactggtcgttaaagactgacgccagatgggcccgccgaggctatgagcacttcaacgcgacgtgtagtccgatttcgactttcgtttgcgtcgcagccgtcgcctgtatgcgttttttttggactcaattctcaactgctttggcaagcggcgccgtgtcacgtgtccttccatctgatctgcgcgtccaacaacgagctcagaactaaatcgcggccgcgacttctgcaggacgaaaaaagggcggtctggcggcgcttgcgacagttttgcccagtcgtttttcctcggattgcacaatcgatgaacgcgctcgccctccggggcgcaactagagaaggaagcgccttggcctttttcggtcaactcgccaaatatctgaacaggattggaaagcgtgcggaaaaatcgaagccctccgattgggaaaagtatgacgtaaaatatccgaataagccgcattcggtcagaagcgtcaccttaaatgcaggatttcgtcgcagcggaaatcattctgccggaaatgtgcaccctgcgtcgcctatgatcaaagtgcaaggtggctagcggctcgagcgtgagggacgcgccagaccagcgtttcaacgcagtaacaactaaaaagtgggaaccaaagcgatgacaatttctcggcgtgatctcttcaaggcaggcttggctgcaggagctgctctctcagttccttcgcttcttcgggcgcagaccgcagttgcggcggataaaactgttcggatggcactggaaaatctcagcgtctttgatccggtggccacgacagccggcatcagccaaacccatgctctggcgatctacgacacactgttctcggctgactcgcagtctcaacctcatccgcaaatggtggggaactggggcgtttccgatgataagaagacgtacacattcgaattgcgcgacggtttaggatggcatgacggtacccctgtcaccgcagctgactgcgtggcgtcaattcgccgctgggcgcaggttggatccggcggacagatccttatgtcgcgagctagcgacatctcaaaaaaagatgacaggacatttgtcatctcgctcaaggagcccctgggggctttgccaagcatcctggccttcgagggtccgtttatcatgcgggagaaagacgccggactacctccgacggagcaggtcactgcgaacatcggatcaggaccgtttaagttcaatcacgacctagccaaacctggcgcgagtttcacgtacgaccgcaacgaaaaatatgtgccgcgcaaagagccgcctgacggaatggctggcggcaagacggtctatgtcgatcgggtcgtgtgggatatcggcgtgctcgccgacccgcagacttccgtggccgctcttcagacgggcgaaatcgactttctctacaggccgccgattgatctgttgcctctaatcgagagcgatcccaacctgaaactcgaggcgctgaatagggctggtgtggacatgactctgcgcatgaattgccttcaggcgccgtttaacagcgtaaaggctcgacaggcattgctccacctcgtggaccaagaggcagtattgcgcgctgcgtacggcaatccccagtatttcaagcccgtcacgtcaatgttcggcaacacggcagcggttaccaacgacgaaaatacgggatggttcaaaccaggcggcgatcccgaaaaagcaaagcaacttttcaaagaggctggctatgcgggcgaaaaaattgtcattctgcaagcgaccgattgggccgagcaaagcaatgcttcacaggtcgtggcggcgaagcttcgtgaaatcggcgtcaacgccgagctcgcgccgagcgactggggcggccttgtctcccgccgctcgaagaaaaaccccgccaacaacgccggctggagcatctttatcactgaccagtctgaggcaacacgtgccaacgtttttaccgacattagccttgccatgaacggcgaaaaggcatggtatggttggccaaagaatgatgaatatgaggcgctccgggccaaatggttgaccctcgaaacgctcgatgagcgcaaggcgcttgcgcgcgaaatgcagaagctgtggtgggactacgtccctgaggttccgctcggtcaaaacattgtacctagcgcttacagcaagacgcttaccggcctcatccctgcaacactgccgcttatgtggaacatgcagaaggcctgataccgtgggtgtttacattcttcgcagactggtttcgaccatcgccgtaatggcgatggtcgggattttcatcttcctgcttctcaggctggcgccaggtgatccggcggcggtcatcgcaggaccaaccgccacggagcagatggttgctaacatccgcgaggagttaggtcttaacgaaccgttgcctgttcagttcgtccattgggcttctgatgttttgagggggaacttcggagcctcggttttcacgggggtgcccgttctccaactgctttcccagaggttggaaccgacgatctccctgtctgtgttgacaatgatcctttcggtcaccgttggagtctccttcggtgtactggcggcatggcgatctggcggtttcgtcgaccgcgccctcgcgactttttcagctatcggctattccgtcccggtcttcgtcattggctatatcctcatctacttcttcgccattcaaactcgttggcttccggttcaaggatatacgtccatcaatcaaggtgtggcgccctggttcttacatctgatactcccaacggtcactttgagcgtcccctacatcgccttcattgcgcggattacgcggggcagcatgctcgaagtgctgtcggaagactatatgcgaacagctgccgccaagggtgcctcgccatttgccatgctattccatcatgcactgaagaacgccggcgtacccattcttactgtgatcgggataagcttcgcttatatgatcggaggcgtcgttctgacagagaccgtgtttaatgtgcctggcatcggccgcctcgtcgtcgatgcaatcaaaaaccgtgattatcccatcatccagaccgtgctggtcctaatttccggcctgtacgttctgatcaacctactcgtcgatcttgcctataccctgatcgatccgcgtatccggtactaaagatggcccttaccacttcgcgcgcttcgggatcgcctcgtattcaaacccacaccgttgtccgcatcgcaaagcggcatccgctggtcctcctcgggggagggatcctgctgttgcttatcttgctcgcgcttgctgcgcccctttacagcggtgatcccttggtgatggaccccttcaagcgtctccagcagccctccgcctcaatgtggttcggcaccgacaacctggggagggatgtcttcgcccgaacaatctatggagcgcgcatatcactcatcgtgggattgctttcagcagtgtgcgcagcggtttgcggtcttttgatcggtgtaatcgccggctacagccgcacctttgataacattatcatgcgggttatggacggactgatgtccatcccgacgttcttgctcgctatagcgcttctctctctcacgggccccggaattgggattctcatcgttgcaattgcgattccagaaacacccgctgttacgagattagtgcgttccgtggttctgagcgttcgttcgcgaccctatgtagaagcagcgctgtgtggtggggcacgcctgcctagggtgctttggcggcatattttgccgagcaccattccgcccttgatggttcaaagcgcgactgtgtgtgccagtgcgatcatgaccgaggctggtttgagctttatcggcgtgggcgtgccctccgagatcccaagttggggtaatatgatcgccaactcacgcctctttctcgcgatcgctcccttgacgatctttgctcctggactgtgtctcgccgtcactgttctggcggtcaacctgctcggggatggcctgcgcgacatgttcgacccccgttcgaagcggaggcgttaaaatgagaatgcaatcaaatccgaaagccgatctgcttctggacgttcgcgacctggagacgcacttttacggcgaagagagcgttactcgtgctctgggcggtgtcaacttccatgtgaaaagtggagagatgctgggtattgtaggtgaatcgggatgcgggaagagtgtaactgctctttcgattcttcgcttactcccaaagcaaacagctaaaacagtcgggggcgaggtcatcttcaaggggcgcaaccttttagaactgtctgagcgccagatgcgtgaggtccggggtaaccggatcgccatgattttccaggacccgatgacaagcttgagtcctgttcacactgttgggcgccagatcgctgaagcagtccaaattcacggccgcgtgtctcgcgccgaggccctcgaaaaggcattggagatgcttcgacttgttcgcattgccgatcccgagcgacgcctcaacaactatccgcacgaaatgtccggcggaatgcgccagcgcgccatgatcgccatggcgctcgcatgctcgcctgaacttttgattgctgatgagccgacgacggcgctcgatgtaacgattcaggcgcaaattctgcggctgatcgtcgatctgaaggaccgtatgggaacggccgtgatgttcatcacgcacgatcttggtgttgtcgctgagacctgccaacgtgtcatcgtgatgtatgccggccgcattgtggagcaggcgagcgtcactgacctgttcgctcgccccacacatccttacacgcgagccctcatgaattctgtgcccgatcggcggcgcggtcggcaatctcgccttcccgaaattccgggggttgtaccgagcctccgcgagcctcttgtcggctgcagctttgctgagcgctgcccctttgcaattggggtatgtcgcgaaaagatgcctgtcctaagcgagatacaacctggacacgctgccgcttgctggcgttcgaatgaagtggtgaacctatgagcgacgcgctgctgaaagttgagagcctgaccaagcactatcctatcgaagcgggatggttcaagacgaacgttcctgtagttcgggcagttgaggacgtgtcgttcactgtccaggcaggagaaacgctctgcgttgtcggtgaatcaggctgcgggaaatccacgcttgcgcggctcctgatgcggctcatagatccgacgagtgggcgagtgctggtggaggggaccgacatcgcaggactaagaaagaacgagctcagagcttggcgccggcggatgcagatggtgtttcaggacccgtactcctctctgaacccgcgtctcaccgcgggccagattatcaccgaaccggtcgagaacttcgaatgtctaagtagaagacagcgccaggaacttgctacggatctactccgcaaggtaggaatgtcgccggagatggcgtctcgatatccgtcggaaatgtcgggcggtcagcgccagcgcttggggattgctcgagcgctggcacttaaaccttcactcatcatcgctgacgaagccgtttcagcgcttgacgtctctgtgcaggctcaaatcctaaatctgctcatggatctccagcaagaaacagggatagccttgatttttatctcccatgaccttgcggtcgtggagcatatcggccaccgcgttgcggtcatgtacctggggcgcatcgtcgaactctcgccccgcgacgctctttttgccaagccagttcacccctacacagaggcattgattgcggccgcgccagttccagatcctgctcgcgccaggctagaggtccccttggagggagaagtgccgagccccgtcaatccaccgagcggatgcgcgtttcacccacggtgtccgctcgcggttgatcggtgtcgcgctgaagtgccgccactcgtccctatgcccgatggtcgtgcggtggcttgccacgtacgggccccggctgccgcggctcatatttcgccgagcgctctcgcgtctcttgcactgccaaaaaccgttcagcccggcggaacaattctcgcccgtcgttgaatcaaaaagctagcccagaacaccaaggaagaaatatggagaagtgctcacacgagagcggtcgtcattcggcggagaatgacggcaaatacgatatcactggttcgacggcgacgaacgtcgtggacggtttcacaatggtggcagttggcgacgttatcgtgtcgcgagccctggcgaacgggcaccatccgggctttagtgagatcgtcgagctcctgcgagccgcagacgtaactttcggcaacatggagacgctgatcttcgacatcagatcattcaatggaacaccgcaggctgagtacgggggggcgtatcacgtcagccttcccgagattggacctgatctgaaggcgatggggttcaatattatgggccgcgcaaacaaccattccttggactggggcgtcgaaggcatgcgtgagacgagccggatcctcgatgagagcggcatcatccacgccggtgtgggtgaaagtcgcgcacaagccagcgctgcacgtcttttagaaacggcccgcggtcgcgtcgctttgctctcatgcgccacctcattcacgccgatgtcgcgtgcatgcgatccagcgggcgaggcaccagccaggcctggagtcaatgcgctccgtctagagagaagcgtcgtcgtcgagcccgacatgcttgagagcctaagaaagatacgtgatgccttgcccaatcctgggcctaaacacgatgatcgcgaaatgttggtgctcgcaggaacgacctatagaaccggcaaagacgtcggctacacctatgcggctaatacgcgagatctggccgatattttaagaaacgttcggcgcggcaagcaatattccgatttctgcatttttacaaaccacgcacacgagccgggaaattggagcgaagagccggccgattttgagcaggcgcttgctcgcaagctaatcgatgcgggagcggacgcgtacgttggacacggaccgcaccgactgcgtggcatcgaaatctacaaacgccggcccatcttctatagtctggggaacttcttttatgatgacctccggacacccgttggggcggacatgtacgatgtgtacgacaaggacccacaggtggacaccgatgccgaagtaaccgcagcggaagaaacaatgggttaccctacggctgcagggttcataggcgcgctcgccgaaccggtgtattacgagagcgtcgtcgcagttagccgctttgaggagaaccaactggccgaactgcggctttatccaatcgagctcggttattccaaaaggcttgcgaacaggggcgtccctagtcttgctccacgccctcaggcaatctcgattcttgaacgcctgcagaggttgtcagagccgtttggaacgagaatcaccatcgaggaccgtgtcggtcttattcgcctctaatcgcatagacggtcgacgcgccataaggttccattaacatggctcagtagcttcattgagcctgcaaacggcggcttggcggccgtttgcgagcgcgccagctgaatacgcgcgccccgtgttcagatgatcgaaggtcaaggattgcagcattgcaagatgttctcggctgcgatggggcaaacttggtttccaggtccgtgacttcgcataatgggaacctcaatagaggtaagttcctcatctgtcgtacgccctcgactcgccacatccgtcgcggcctccgtcgcgcggatcctgatccggcgtagagggcgctcagtttgcagcattcctgcgcgcaagtgatcgaatacgcagtcaattccatttcatggtcacgtacattttaggtcgaaacaagcgcgttcgagcgcctgacaacaggaactcatcgccaaatccttcgcagcccgagaggaagcatttatgaccatcgatattaaggacatcagcgagaaggaccgcaatacggtcctgcatccgttcacacagctgaaggactttgcgaccggaaagcttcgtgagccgacgatcgtcgagacgggcaaggggatccgcatccaggacgcgcgtggtaaccagctgatcgacggctttgccggcctctattgcgtcaatgtcggctacggccgcaccgaagtcgcggaggcgatctcacgccaggcctatcgccttgcctattatcattcatatgcggcacacacgacggatgaactcgcaattctgtcggatcgcctcgtgaagatggccccgggcaagatgagcaaggtgttttacggcatgtccggttcggacgccaatgagacccaggccaagctcgtctggtactacaacaatctgcgtggcaagccgacgaagaagaagattatctcgcgcgaacgcggctatcatggctgcagcgtcgtctccggctcgatgaccggcatgagcttctatcacgatcacatggacctgccgctgccgcagatctgccacaccggcgtgccgcaccattattggggtgcaaacccgggcgagacggaacgcgagttctccgcccgtcgcgccgccgagctcgacgagatgatcgaaacactgggtcccgataatgtcggcgcctttatcgccgagcctgtgcttggtaccggcggtatcacgccgccgccggaaggctattgggaagcgatccaggccgtgttgaagaagcacgacgtgctgctgatcgccgacgaagtcatcaccggcttcggccgcaccggctccatgtttggctcgcagcattacggcatcgagcctgacctgatcaccgtcgccaagggtctgacctcggcctacttcccgctctcagcctcaatcgtcggcgagaaggtctacaaggtgctggaagacggcgccgatcgcgtcggcgccttctcccatggctatacctattccggtcatcccattggggcggccgcagcaaatgcggtgctcgacatcgtcgaaaaggaagatttgccgggcaatgcccgtgaggtcggcggctatttccaggcgcagctcaaggagaagttcgcccagctgccgatcgtcggcgaagtgcgcggtgtcggcctgatgggcgccatcgagttcgttggcgatcgtgagaacaagaagcgtttcgacccattgctgaaggtcggagctcgtgtctccaaagctgcccgcgatcgcggccttattgcccgcgccatgccgcatggcgacattctcggctttgcgccgccgctcgtcaccaccaaagaggaagtcgatgagatcgtcgccatggccgagaaggccgttcgctctgtcatggatgagttggtccgcgacggtcagaagctctgagcgatagttaagccttcggcggcggtggatgccggccgccgaaggcttgtgatcaacgactgcatgaagccggaaaggggcaggagatcacctttgcctcgcagaccaacgcgacctccggacgagaggtcatcaggaatagggaacctggctatgactcccgccaaactccacatgacgaccagcctggcgccgatcgctgttcacagcccctatgatgggtcgctgcttgggtcagttgaggcgaccgatcctgccgacatcgatcgcctcctggcaaccgcccgccggggcgccgagatctcgcgcaatctgccgcggcacaaacgagcgagcatcctcgaaggcgcagcccagatggtcgaaagccgtcacgacgcttttgccgagatcatcgttcgcgaagccggcaagaccatcgttcaggcgcggaaagaggtgctgcgctgcgtcaacacgctgaagctgtcggcggaagaagcaaagcgcaatgccggcgagatcgttcccttcgatgcctataccggctcggagcagcgccagggctggttcacccgcgacccgctcggtatcatcactgccatcacgccttacaacgacccgctgaaccttgtcgcgcacaagctcggcccggcgattgccggcggcaatgcagtgatgctgaagccatccaacctgacgccattctcggcgatcaagctggtgggcgcgctgcgggaggcgggcctgcctgaggaggtcatcaccatctcccatggcgaccgggaactggtgacagcgatgatcgctgctcgtgaggtgcgcatggtgtcctttaccggcggctttgccacgggcgaggcgatcagccgcgcggctggcctgaagaagcttgccatggagctcggcggcaatgcgcctgtgatcgtgatgaatgactgcgacttcgacaaggcagtcgaaggttgtgtctccggcgccttctgggcggccgggcagaactgcatcggcgcgcagcgcatcttgatccagtctgagctttatggccgcttccgcgatgcttttgtcgcggcgacaaagaagctcaaggcgggagatccccttcaggaggacaccgacgtcggtccgatgatctccaagcaggtggcggaacgcaccgaagccgccgtcaacgaagcgatcaaggcaggcgcgacgctgctttgcggcaactatcgcgaaggctccctttatcatccgactgttctcgaaggcacgccgctgacctgccggctgtggcacgaggaagtgtttgcgccggtggtcatgcttgcacccttcgacacgctcgataaagggatcgagatggccaacgatccggactacagcctgcatgccggtatcttcaccaacgatctcaacgtcgcactggaggcagcaaacaggatcgaggtgggcggggtgatgatcaacgactcctccgactatcgtttcgatgccatgccattcggcggcttcaaatacggcagcatgggccgtgaaggtgtgcgcttcgcctatgaagatatgactcagccaaaggtcgtctgcatcaatcgagggtgagccgtaagttccaagcggttgactgaatgcgcaagcgtacaggcgcggggcaaatgctcctcaccaccggcgtaacttgaggggagattatggataagacccacggcaagatctgcgtcgccgaggtcgaggagatcgcggcggtcggcagcctcgatcctgaccagatccacctgcctggtatttaagtgcatggccgatcaggggccagcacgaaaaacgcgtcgaacaacgcacgacgcgcgcggcggcttgagggtagggggaagaaatggcctgggggtgcgcgtgctcaacacgctgctgttcgcgacgaggcgccgatcggccaggaagcgtcttgcaacgttctgcatcgacggcggcagggcatttgccatgtgcgtggaatcgtgtgaaggaaggtgtaagtgtcatgaccggcgccgagtttcgtctctgcgatgtcgcgctcgactgctcgttcaaaacccgcgaccagcgagttgagcgcgaacaggcactcgcggtcctcgacctcctcgaggcgagtaccttcgtgcccgtcggccatcacggcggcccgtatcgcctcaagatctcgatggccgccggccggctggtatttcatatcgccgacgataagggagcgcatatcgtcagccaccatctttcgctcgcccctttccgtcggctgcttaatgactacagccgcacttgcgaaggctactacgaggccatgtgccgctccaacctcgagcggctgcaggcgatcgatatgggccgacggggcattcacgatgaggctgccgagctactgagggagcgtctctctgctaaggtcgacatcgacaaagacacagcgcgtcggctgttcacgctcatttacgcgctgctcgctcgcaactccggccatcagatccttttgaattgaatagcctgcgatcaacgcccacaagcgggggggactccccaccgtttaacaagcggatttttgagcggccagagaggggtcgaaggtggtgccagttttgagcatggcgcaggcgacggcgaggaggcggtcggcgactgatcgcagggcgcgaccgtggctgtgacctcggcttcgaagggcggcgtatttcaaacggttgtgaggtcgtgctgaacggcgacgcgcgcccaatggtacatggcgttggccagtcggtcatggcaggcctgtcttctgacgacgatgcagctcttgcccgagcgcttggtgaccggcgcgactcctgtcaagctgcgcaaggcggcgtcgtcacgtcgctgcagggcatcgaacgcttctgcgagcagcgtggcgaggacaacccttcccactcccggcaaggatgcgaggatctccacgtcatgctgcttcttctgccccggctccacctgcgcggttgcgatgaggctggcggtcaggccatccagccgatgatgcgcctgtttgagctgccggttgacgaggcggatgcgggcaatgagcgtagtgacgtgggcgctggcggattcggtcgttccggcggcgaccttgagcggcggctggcgcaatatatcgagcacatgggggggcgtcgaagcggcggatgcgatggcgcttgagaagcttggcgatcgtcgcctcgcggatgcgcgcggctttgtccggcgtcggcacggtgtcccagagatcgagcaaccactctgccccgaggtcgttttcgagctcaagcagtgcggggaagtagcgccagagctgctcgcgcatacggttcgtcaaacggttgcgctcggcgctgaggtcttcggcgatgcgcgaccactcgcgcaattcgatgacgacggggtcggagaccgcgagcagccgaaagcaacgcggatcggtgcgcagggcggaagccatcacctcggcatcgcggctgtcgtccttggcaccggccatggtgaagcggtcgcggaaacgatccatttgctttggattaatggcattcaccttgaacccgcgctcaatcagcgtctcgaccacggggccgtgcggcacctcgattgcgacctggatttcgtccccctcaaccgcgccgctcgtcgccatcagccaggccgccatttcggcgagcccttcgccgccgtgcctgaagaccctttcgccgatttttcggccatcaccgtccgtgaggaacacatgatggctctccgacgcccagtcgacgccagcataacaatgtctttgatcagtcatgccttctccccgttcgagcatacgagccaccgcgatcttcgccgatccctgtactggcgctcggaaaagcacaggtccggcgcgaactccccacggggcatcgatcacggccaatccgacggggcacgtgtcccccccaggtgctcgaggcacagggggcgatgggtcgctcccgacgaatcggctcggttcaggaaggctacgccaattcgggccgtcgcccatggtgcacgccacgttccgccacgcttcacgtcgcgcgacccacgtcgagcatccaagaaccgcatgagaagggtacagggggttggtcagcgtccatcagaaatcataggaggaagcacgacgtgcatgcaatatcacagcatccgagtcagcccggcaagacacaatctcgacgcaacgctcctcaagcggttacaggtgcgtgatgcaaacgaattctgctggctttcttgaaagcgtagacccaaaacttccgccatgccatgtcgttccttgatctaccggaggggctgccagaacggatcatccagtgcaactctccctacacggtccgcttcggtgtacggctgcgcggccgcatgtacagcttcatcggctggcgatcggtgcgcgagcactgcgaaccagtgaagggcgacattcgatatgcgtcaaatgctgacgcagaggaggtcgaggcgcttgccgcactaatgacgctcaaatgctcgcttgttgacgtgccgttcggtggctccaaaggggcactcaagatcgacccgcgaggatggaccccgcaggagctcgagcacatcactcgacgctttacgcaggagatgaacaagcgccccgatcgggccaggcgtcaatgtgtcggctccgatatcggcaccggtgagcgggaaatggcctggatgatggatgagttccgccgcgccaatcctaccgacgtggtcacttcgggtgcttgtgtcaccggtaagccgctgtcgaaaggcgggatcgccgggcgagcggagtctacgggcaggggcgttcaattcgcgatccagagctcccttcgggacacccgcacgccgggtttggatggccggcgcaatctcaaaggcgcctccactgttatacaggggtttggcaatgtcggctatcacgccgccaggtttttgtccgaagaggatgatgcacgcgtgaccgttcttgctgaacgtgacgggtatgtcgccaatccggaaggcctctccattgaggccctcaagcaacatcagatccgaacaggcagcattctcggctttgatggagccaagtccattgccggcgatatgtgcggcgtcgaacagccctgcgacgttctgattccagcggcgatggaaaatgctattcatgctgaaaacgcggagcgcatgaaggcacatctcgtcgtcgaagccgccaacggacctgtcaccttcgaagcggacgagatccttcgctcccgcggcgtgaccattcttcccgatctttatgttaatgccggaggtgtcgtcgtcagttacttcgagcgggtgaagaacctcacgcacatccccttcgggctcatggagcggcggcggcgggaacggggcaaccacacaatcgctacggcgcttgaacggatgacaggcaaggagtcccccgcagacatgcgcgacgaattcctcgaaggcggcgccgaaatcgacctcgttcgttccggcctggaagacgtcatgcgcagcacctggacgcgcattgccgacctgatggaacagcaaccggaactcggtgactacagaactgccgcctatgtcgcgtctatccggcaggtcgctgatttatgaggcgattgggatatgaccgcgtatggcgaaaacagcgtgcggcgctaccgactacgcttactctcacgcatggctccactcccggcgatgcatgcccaagtggcgagtatcatcgggggatatcgcacctcttcttcgatgggagcgaactctacggccatcacagtcgagcgcagagaacatgtgtctggaggcaaagtggcttcagcgctacggcggggggtcaattcttcgattcgcttgacaaaacccacgagaactggatggaggccaaccgatacatcgacatggacgatctcagagagcacaagaagctggctctccgcaacgccgcatgaccagccccatcgccgccccaatttgctgaacttgacgcacagaacctcattttgacaaggcgagcttcgggggtgctggtgcttctagggctcggcgcattggtttcgttcccgagttgccggccagttgtccgatagcttgggtgccgcgcgggtcggccgaacgatcgctatccttcctggtttcgatcgccttttttgggcttgcgccgacaataccgctgctggcgatcgcgctttggcatgtgtcatggttcgatggacatggcgatgaacagatgggtgcggattccgacgatcgcgcgcatgcattccaatctgatgccgcgcaccgttccgatttgatcgcgcgcatgtgaggcgaccaatcgttgggggttaaatgggactacgaacttatcctggtcaagctggcgccgatgagatcgctgtggacggctgaagactgcctccaacggagcgaagcagtccggcgccgcgcttcccaacgcgccgtaggggccggtctgcttcgcgggcggcgtgtccgacattcttttggccaggatattgtccacgggtttggggtccggcctttcaggtctggatttcggccggttgacgcagccgacgcatcgattcgccgctcatttcaagcctgtgagcgttgtgaaccaggcgatccaatattgcgtcggcataggtggggtcgctgattttttcgtgccatcgggctacggggaattggctggtgacgagcgtcgagcgtcggccgtatcgtccctcaaggatctcgagcagataatggggagcattaccgtcgatgggctgaagcccgtaatcatcgaggatgagaagttcgacggcgccgagacttttcaggcgcgttgcgaggctgccgataccgcgggcctgttccaggctctgcagcaatgccggcatccggacgtaaaggaccgaatgattgtcgcggcaggccttgtgtcccaaggcacaggccaaccagcttttcccgatgccggtcgggccgacaatggcacagttctcgtgttttctgatccagtcgccggcaatcagcaggtcgaggatggtgcgatcgtattcgcgcggtgcacggcgaatgatatcttcgggaacagcgggatggtgcagtttcgcgttacgaagtcggagcgcaagacgcttgttgttgcgccaggtggcttcctgatccaagagcagcgccagccattcgccatgactgaggttgtcgctctcgtcattatcggccagtcttgtgaaggcgtctgccataccggcaagccccaattgctgcagcaggttgagggtaggatgtttgagcatttttattcctttcaatggtagtattcggagccgcggaggttggaatgctggatcggttcctgctcgaggcgctcggaccttgggaggcggtcgagttccttttcgagaatggatttgatgccgggatagttgagcacctggaattccagcgcgcgctgcgcagccgcttcaaggcgatcgacgccaaaccgtctttccaggccgatgatgccgacacaggcacggtatccctgttcgggatgcgcgcgcttctcaatgatccgatcgacgagaacgcgcagcatcggcccgatccgcttggcctcgctgcggatcttcgccggcgtccattcgcgataacgctgatggtttggcggcatatgcaccgcaaccgtcgtgtggcggccgttgctgctgccacgcacatgcgcggcaattcggtcgccgccgaggaatatttccaccgtgcgaatggtgtatcgaacctcgacttcgctacgcgcaaagcggtaagggacggaataaaaatgccgactgagttcaatatgataatcgatgccaacacgacaccgacgccattccgcatgcacccagggctcggcaggtagcggcttcagattcggggcatcaagttcgtcaaacaacgcgcgccgcgtcttgccgtactggcgtatcacccgttcgtcattgagccgggtgatcagatcggcaatggccttgttgagatcagcgaggctataaaaggtccggttccgcagccgacccagaagccaacgctctacgattccgacgcaattttcgacttttgccttgtccctcggttttctcgggcgtgctggaaaaactgccgtgctgtaatggcgcgccatatccgtataggaacgattgaccatcggatcgaagtgacaagccttgatcaccgcgcatttggtgttgtcgctgaccaggagttgcgtcaccccaccaaaaaaccggtaggctgcgttgtgcgcctcgatccagtcgggcaactgttcgctccacgtcgccagcgcgaacgacaggctggacgcccccatcaccgccacgaagatatgtgcgtcccgcaccacgccggttttgcggtcgacgactgccaccttgtcaccggcataatcgacaaacagcttctcgccgccggcatggctttgccgcatcaccagaggcagccggccatgccagtttcggaacaactcacagtatctcgaatatcggaacccgtctggatcccgagcaatgtactcctcccagagcacctgcaacgtcacatgcttgcgcttcaattcgcgcgcgacggcagaccagtcgggctcggactgcttccgacgcccagctttcttaccgggcgtcccgtaaaggcgctgctccagctcgcggtcactgatcgtatccggtaaaggccatgtcagtccttcccggtgcaatcgctttaacgtgtcgcggaccgaagtctccccgacgcccagttgcttggcaatgatgcggttcgaaagaccgacatccagccgcagtttcaaaatctcgcgcacctggcgcatcaggagtctcctcgtcggcaattcacttctccatggcgttgcttccacctggagaaataaccccaacgatcgggcctcacgatatcgacttactgcgcgcgattatctcggaatgctgcgcggagaattgtcggaatggtgcgcgtcatcatctcggaacggtgcgcgcgatcaaatcggaatggtgcgcgcgatgagcccggattccgcacagatgggcgagcgaggtggagaaacacatgaggcggtcagtgatgtcgtcgtttcaggccatgtggagtgtgggggctgttctgggcgcagcaaacaggccccagtatacattcatttccttgttactgccgtgatgaccggcgggatcctcggacccttccttctgctcgattggcgatcaactatccagacattcatagaaataccgctggaccgttgagcagggcggaaagtcctttggcaacatccgccattggcagcccgttgaggcgatatagcagcgcgttcacaacctcgcgcaaatcggtcttgcgcgggcggccgagacggcgcggcgcaggcacgaacggtgcaatatattcccattcgcgatccgtgacatcgcttgcatatcagctcgtccgacggatataattccgccgggtggtttcagtccaagccatcgtaggctccatcgaatcttcgcaaatccgacggaatcacaactgactgaaatcactcaattctttttgggcagcctcttagacctcaattccccacgtcacaggatacttgcctttgcagcaggcatggtgggttccttcgttagcgggttgggcaggctcccgcgggatcgactgcgcggacgggatctcaggtggtttttcgaccggcaggcgcactgcggcaggtcggtatgcttgcgaatcacgcatcggcggcaaaggggaacggatgctccaagtcaagatggcaacaaggcatcaagcagatcggaggcaacagtgctgttggaggcattcgagggcacaggttcatccacgccgggtcaacccacgtttggctggctcggaagccagtgttgtattcatgaggtttcttttcgcgcggcatcattcacgatcttccttgcctccacggttacgggtaggctggtgtcttccggaaggtcgggcagtaagagccgccagccatttctgagcaccacaaagccgccccacaggctttcattctcaaccttgacaatcggctcttcgatatctttcttgggaacatacgctgacaagccgctgccgcttctgcggatcgttaccctcatctggcttttccttcgttgacacccctggcgcattcagtggtttttggcgttgaggtccccccgaggctcctcagttcacgcgtacgcattccaacgacgatgccgcgatcaatccattcgacggcataaatgtagaactgctggagaaatgtccctacatcgcgcacaaaacccgcgtcgcctttcctgacgaggcgttctccgatttccttcccgggataggtgccgtcattttttatgtggcgtgtggcacaaactctctcacccggcataaatcgtggaggattgtggatttcgacttcctcttcgcgtccaatactcattaccattcctcttgtggttgcgattaccagggggagactcaaggtccggccgcgcacggaagcccggctatggcattcggggcttaagccggcacgcaggtcttcggcatgggacatacagaggcgcattgctgtatctcgaaaacgcccttgcattcggtgcatttcttcggatctatcacgtacttttcgccctttaactcgatagcgttggaagggcattcgaactcgcaggcgccgcactgggtgcactgggatgcgatgattttgaaggccatattattcagctcctggttaggtctcgatcgatgggccaagctcaagccgttgcctgcgatggggcggtaccaaactctgtcgcgtgaagagcgctgatcgcggcctcgatgtagtcatagccataggtgtccgttgcccggatcccagcttccatgagcctctccttcggacaatctcctatccttgcgcagagcacgatgtctatgccgtcgagtgcagcgatgatgccagcgagggcggcgtcctcgccccagccgccatggcaatacggctcgaccttgcggtgccccacgaatttaatccctgtttgcgaggcttcgtaaacctggaactccttcgcatggccgaagtgttcattgatgcgtccgccgcctttcgttgcgacagccacctgaagcgatccacggatgttcgcagatgcgaccgttgcgatcgctttctccttagcctctaaatggtcatcgcgtatgcgtgcgaccacctcccggtaggcctgacgcttggcaccgtcgtaatggggttcgagcggaacgtggtcgagcgtgaactcctggccacggtcagtgccgagaaggccgactgcatcggcacggcactgtcgacagtgacgcatcagcttggcaccgccttcaagacggtcgtgaagcgccttcagttcgagcgcatttgggccgcgctgtccggtcaggccaaaggaggttccgtgtgccgggtctgaaatcagcggcatgacattgtgcagaaacgcgccgcgctccttgacccatttgttgacctcgatcaggtgcaggtcattgacgccggggatcataaccgaattgatcttggtgaggatgccgcgtgcggtcagcatctcaagtcccaacatctgctgctcatgcaggattttggcagcatccacgccggtgtagcggcgatgcccataaaagatccacgggtagatcttctcgccgacggcggggtcgaccatgttgatggtgattgtcacgtggctgacgttcatttccgccaacttgtcgacatgctccggtagagcaagtccattggtggaaatgcacagcttgatgtccggaatctcgctggcgacgcgttcgaaagtcgcccttgtcttgttccagtcgtagcaagcatcgcccgggcccgcgatgccgagaactgaaagctgcggcacttcgttggcgaccgcaaccaccttgcgcagcgcctggtcgggtgtcagcttttcggatacgacgccaggccgactttcgttggcgcagtcatatttgcgattgcagtaattgcattggatgttgcaggctggtgcgactgcgacgtgcatacgggcgaaatagtggtgcgcttcctctgaaaagcaagggtgatccttgatcttctcccaggtggcagaatccatgtcggttggccttgaggacgagccgcaggacgaggacgcgcaaccaccggattttgcggttgtcagcaactgcccagaggatgtcgtgttcgtcaggctttcaagcgaaattatcggtgcactcatcaaacggctccactggagtaaaaagtcgtcgtccaaaaaagcaagcgctgtgccaacaggataatatcgaaatatcaatagtttggcgcttcgtgttcgatttgaaccaatagcccccgacgcagttttgtcgaattcgcgacagaagcggccaaattggacgatacacccgcgcgcctgaggaggaggggaatggccgagcccagataagagggctcaccgtctctagatttttttcacctgtatatgatgccgccgtaaagcatagccgacttgccgcggtgtgaggccgaggatccgagctgccttcgcctgaacccagccggccttctccatcgcgctgattagcagctcgcggtccgatagatgtggtgccaccgttaagccgccagggccggcggggtaaccgagactggccggcgattcgactggcaaacgtttgctcatggccaatccattgagcgaatggctgccaagcggtctgtcagcagttttcccgagcattgaagaaaagcactggtcattctggcaggagaaatctgatggaacaatcgtcgccgaacgtgcgagagtggcggtcctgcggacgcagttttcaagctctcggacgttgccgggaaatttgcatcttgacaggatctcgagtgccgcaggcgtgaattcgagattgcgattgttttccctgttgaaccggtcgaggaaaaccttcgcaaggcgtggaatatctccatttcgctccctgagaggcggtaaaaagagaggcactacattgatgcgataataaaggtcagcccggaactccccctccgccaccgccgtctccaggtccttgttggtggcgcatatgagtcggacgtccaccttgagcgtttttgtgccgccaactcgctcaagctcaccttcctgcaagacgcgcaacagtttcgcttgaaaggccggcgagatctcgccgatttcgtcgagcaacagcgtcccgccatccgccagttcgaaacggcctgcgcgctgagagatggcccccgtaaaggcgcccttctcatgcccaaacagttccgattccaggacgcctgcagacagtgccgcgcaattcaacttcacaaacggcttttttctgcgaggtgaaagctcgtggattgcctttgcaaagaattccttgcctgtgccgctttcgcccctgagaagcaccgcagagttggtttgtgcaacgactttgacgctttcaaccacttgcctgagtgcggggctttccccgacaatccagtcgattctcgtaggccgttgtcgggttggttcaggcagttccttgtcgcctccactaatcttgcgatcgccctcctcgccgatcggtcgactatcgcggctctcgtggccattcagccgaaccgctcgtgccgcaaggttggcgaccatcgacaggaaacgcacctcttcctcaaattgtgttctggtggctgcgccatccttggcgcggtcgatccataatgttccaagcgtttcttgatcggccttcatcgggacaccaatgaaggtgacttggccagtgccgctcacgatactctgaagctcatcctggaacagttccgacttgcaagtgtccggtacgaccagcggcgcaccttttgcgacgattctatctattgcagccttcgcagcaatgtggcgcgcgcctgatgatggaggctcaaccccgaacgtcgcagttgtctcgggctctccttcagcgccaacaacgacgattgcgccgcgccgcattggcaaaagtgcggggagggtgttaatcacattggcaagcttgatctcgaggctggctgaagtgatcaaaaccttcgatatccgatagagaccgctgcaccccaagtcccgtttgtgcatggttttaggggataattcagtcatacactcatcgagccaattcttacgaggaaacaccttgagcgtcgtacgaacggcccttggctccctacgagaaaatgccgccttgctgacattatcaagtgcttgcgcttgcacctgtgagcgcccgtcaacgtacccatcttgttagacaaaagtgagatgcaagtcatccgaatttaaagagcacaccgaatccacctcgcggatagctccaatcaatgtcaccgctctcttcgcacagtactctacatgtcccgcattccatgcatccatccgcaataacctctacttggccgtcttcattcacctcgtagcatttcgctgggcaaacaacggtcagcgcaagcaggtttgggctcggagactgatgctgccgcaccttgatgtgcggccgccccgcgtccaccaggtaacggttttggtaaagcttgtcttcaatgcgaacgactgaagctgtcatctcaatgctcccctttagcgccatgccagtgccaagcggactgcgtcgctgaccagtccccatcgcgaacgcgctttaataagagcggccgtggtcgctctttccttctcgatcttgggtgtgccgtcgacgcgcacgaagttttgcgccgcctgcgacatcaactgcggataagtcgtgaagaaattgtgtgaattcgtgtggagcagagcgggcatgtccttgtactttctgaggtctttcagaacgaaagacttgtccagcatggccttgtaaagtgagagattgtcactcgtcatcgggtgttttcggctcttgattgcggcgatcgcctcgccggcgatgcggcccgacgtcatggcgaggttcgagccctcgcggtgcacggcgttgttgagctgcgccgcgtcgccaaccacgacccagccatcgccaaagagctgcggaattgccttgaatccgccctccggaatgaggtgcgccgcatattccttaatctccgagcccgcaagtagcggccggattgatgggtggttcttgaatgcgtcaagtagcgcgtaaggactttccagggtcgctgcgaaatgggagacaaggcagccgatgccaagagagatcgattccttgttggtgtagaggaatcccaagccggccattccgcgcgagattgtccctgccgcctcaataacacagccttgatcgccggtaaggccgaagcgttcattgatgacctcttccggtaggaaatgcatttccttgacagcgagtgccacggcttcgggtttcggcaccttgcgaaatcgtgctctcgtgccgaggaggccgtttacgccttcggcgagcacgaccacgtccgcatggatgaccccgcccgctcgatcggtatggacgcctatcaccttgccggcagcatcaagagccagttccgtcaccgtcgtctcgcacaaaactatcgcgcccgccgctcggactttccgcgaaaaccacttgtcgaactgggcgcgaatgatcgtgtaacggtttggcgccggctcattgaagtcgtccgaccggtagtgcattccggtgtgtgacgtgtcgtccgttacccagaatcgctgctcgaccagatgccgctcaagaggtgcatcatcccggaaatcgggaatgattgtctccagcatgttggcgtacaagatggcgccttggacgttcttggagcccggatattctccgcgctccaactgcaacacttttagaccgcgacttgccatggtgtatgcagccgcgtttccagacataccggcaccgacgacgatggcgtcgaatctttcttcggtcataggttttacctcagttcacaactctcagacgattggccggcgccaaccgtttggtgaaagcttccgtcaacgccggcagaaagctgacagcatcggtgacaacaccgacatgggcgaaatcgaagatgggcgcgtgtggatcggtgttgatagcgacaatcaggtcagctccctcgacaccgacgcggtgctggaccgcgcctgatattccagccgctatatagagcttcgggcggatcgttttgccagtttggccgatctgccgatcagctggcatccagcccttttggacgagcggcctggaacagccgtagtcaccgccgatcgtcagcgcgaggtctttgataagcagcaggttctctgcattgctgaggcccagcccgccggcaaccaccacatccgcataggcgagattggcgttgcccgatcggtcgtcggaaaggaaaccgacgaccttcgtgacgatatcttcctccaacatccgccaatcgtgccggattacccgcccgatcggcttgtttgaccgctgtggcatgcgcatgacccttggccgcacagttgccatttggggccggcaattgagcgtataaatcgtgcaaagcaacgagccaccgaacgtgggccgagtagctgcaagcgaaccgtcctcgtcgacatcaagtccggtgcagtcggctgtgagccccgtcagcagtgtggtcgccacggaaccggcgaggtcgcgacccagcgtcgtcgcaccgagaagcagaatctcaggcttatgggtaatgaccagatctgtcagtgctttggtgaaaggctcgtttctataatccgtgagcagcggctcctcgacgagatacaccagatccgcaccataggcgaaggcctcagcagcggcgtgcaaggtagaatcccccggaggcccgagaataatacctgcgagctgaacccccagttggtcggcaagtctgcggccttcgccgagaagttcgaacgagaccgggtggacatggccgcgttccagctccatgaaaacccagacgtgccggtagtctctgaattgctcaggcaggtcctttttcatgctggcacgggcttgggccggtggtgatgctttactttttcgagttcccataatctgctcctatctgctcacgctacgagtggaggagagctcgtgctccagtgccggctgatgggcgaagattgaagtgaccagttcgttagctacgtcctgcattgccttctcgacggtgtcgatctgcaccgctttttgctcgcgcggggtaggggcaaagacccgcttgacgaccgtcggcgaaccgcgcagcccgcattttgtgatgtcttcaatgccagcctccaccgcattccacttgacgatttcgctgcgcgcggcccgcaaggcatcatcaagtgagccgcggcgaatggcattcgatccttccagcatggtgatcaggcaaggcaattcgctcttcaggacgtgcgtcccgccttccgcgcgacgctcgaccgtaatcgcgcgcgtgcggagatcaatggaagtgacctttgcgacataggtcaactgcacgaggtcgaggcgcttggctattccggggccgacctgggcggtatcgccgtcgatcgtctgcttgcctgtgaagacgatatcaggcgatccaaagctattgccaatcttcgcgattgcctgagaaagagcaaatgaagtcgccagcgtgtcggagccggcaaagtgccggtcggtcaggagtatcgcgcggtctgcgccataagtgagcgccttgcgtaaagattcttcggccatgggggggcccatggtgagcaccgtgacctcgccgccatggtggtcacgcacttggagtgcctgttcgagggcaaacaggtcgtaagggttgatgatagtcggcacgccttggcgcatgatcgtgttcgtcaccggatggacgcgtatctgcgccgaatccgggacttgcttgatacagactacgatgtgcatgaggtctctttagctccgatcgcgtgtaaaatgacgtctttcgcctcccttccaagcaccaaccatgccaaccaactgtggtccaagaagcccatgaattctaaggagctttttcggctcacaggatgcgacctgcgtgatagcgttgtcggcttcatgacatcgaatcgtcgcaaccgctccgtacttgtcgttttccgatgatcttaggccgagtcccaatgacaaatgtgcggttaggcgcaccgctgatccgacgtgaaaacggcgaagtggttgcaaactccgcgctttatgtaaagtgccccgaagctcttcggcccatggcacttgtgcgcggaaagcgacagcatgaagtgtcttgctgatccttctcgtggatgacctagcattctcgttcccctctgtttctgcgatcagccgaaagacttcccgcaggcgcagttctctcgtgcgttggggttatcaaagatgaatccggcggaatcgacacccgtggtgaagtccacggtcatgccgctgacatgaggttgagaggctgagtctacgtacaccttgaccccacccgcctcaatgacagcgtcgccgtcgcgcgactcgctgtccaagcccaggtggtatttaaaacccgagcagccgcccgcttccactttgatgcgtagcccatccgccggctcgcaagtctgtgaaagcgcgaactttattgcggcaatcgcactgtcggtgagcgttatcatgggttcgtttctcctggtttcgagtcgcttgcgaacgatgcacctagtgtgccaaccagaaaccatcacgaaaacaacgcgttgttcaaacacggccatgtcgtttgtacgacacagtcgtagttacgacattttgggtgattaaaccgagttcgtgtgaggctctccgcgacgcgccgagcatcgacgtttatcctcggcaggggctgctgagactccggcgcggagattggatacccggtcgattgaaggaaactaaaccctcagcgggaatgtgccgtaccgttccgtgccgcagcatgaactgctccggcgcaataccttcatgtcggtgtacataggccaaatgctcctcttgcgaacgcgagttcgatcacgacatcaattgtgatgacagacttgctcatgggaactcgcctttaacttcggttccgtgcccgaagagcggcatagcaggaagcaggatctcggtgaaatcgattatctcgatggcacgcattagctcaatggatcgagggatcgtccgcggagcggaccggcaagtcaccttgagcggcgattttcctgctgcgcggggttcatgaaagtgcgctggaggctgctcagtgggtagctgcggcgctcactgtcagcaccggctccgcaacatcagactggatagctcacatggcaaaaatcaaaatttaatcgggacacgaccgagacgtgcggtgtcgaaagtcctcagcgtttcaagaatgttctgcggagaagatgcccaataaggatccgactcgcagttgtccgagaaaccttcttcttcgaaccattgctccaccacgctatcattgaccacggcagcgtagcgccacgagcgcattccgaagccgagattgtcctttgcaaccagcatgcccatcttgcgagtgaattcgcccgaaccatccgggataagcctgaccttctctaagcccaacgccttgccccatgcgttcatgacgaaggcgtcattaactgacaggcagtagaccgcttcgattcctaccttcccgaattcgtcgtaaagtctctcaaagtcaggcaattgctgagttgagcaggtcggggtgaacgcaccgggaagcgaaaacagaacgacgcgcttgccactgaagtaatcctcggttgtcctgacttcccatcggtatgggtttggccctcctattgtctcgtcgcgaacacgcgtgcgaaaggcaacgaaagggactctttttttcacaggcattgaacatcgctccttcaaaaaagaactgagcattcgccgcctctggaccctctggcgaagcaccgttacttaaataatcagttcgtcggccaacgaacagacagcaagcggcgtgccactttagatccaagcttcaacagcactgcttttggtacgggcatggcaatcttgtgcgcggactggcgcaccttctcgtgcgtttccggttaagaaactcgaccgctgctcttgtcagagagccgacatcatgtcgcctttgtcgtccttccgacacgccgcatttccccctgcttcctacagacctccgtttagcctttgaatggaacgcacgaacttaacccttcggctcagcagactggattggcacgaattttgaaacgcccccggggggcacaattgccgtgcaggcatctctggggcgccctcgtgtggaacgaaagcagggaaggatgggaacatgtcaaatctagctcaggtgcgcgctttgtcgaaagggagagtaacactcggaatcagaatgaccgatcggcccggttggcgacagttatccgaattgctggacctcggaccctggccgcctacggacctcgaaatggatttcgatcagtacgtgtttgcatgtgtcctttcgcgtgcactcgaggaaatcgatgccggcgaggcaactgcaacagaggcaactggtctttcgcaagtagagctgcgggacatcctcaaccgcagttttcccgccccaactattcatgtttttcgcttggaagaggtgagagattcggagcccggccccgaggaggcacttctgcgcggtctgctgctcgcgcatgctcgagcgggcgattcggcgagcgtgctgttcgccaaaatcatagcccggcgtgccttgcgccacgaccatctctggagggagcttggtctttttgatcgagtcgaactcagccgattgctcgccagccatttcccaacgcttgcagccggcaatacccaaaacatgcggtggaagaagtacttttatcgcaagctgtgtgaggccgagggctattcgctgtgcacggcgccttcttgcccgcaatgcaaggaattggagagctgctttggctctggggaaggcgaaagtgcttcaccagtcgggaaagttggcggagaggcttgagctcaagcgccgcctaggtcggctatagacggctgggaggccttttcgtcatctctgcatgcgcggattacgagtgtgcatgcaccaagtggaggaaatcatcttgatcgtagaaaacttggcggaggtccgcggcaagacaccccattatagacatctatacgtccaggtcctcgcggcgatcgccgtgggcatcctgctcgggtatttctatccggatgtcggctccaagatgaagccgctcggcgacgccttcatcatgctcgtcaagatgatcatcgcgccggtgatcttcctgacggtcgcgaccggcattgccggcatgaccgatctcgccaaggtaggccgtgtcgccggcaaggcgatgatctacttcctgaccttttccaccctcgcgctcctcgtcggcctcgtggtcgccaatgtcgtgcagccgggtgccggcatgcacatcgacccggcttcgctcgatgcaaaggcgatcgccacctatgcggaaaaggcgcatgagcagtcggtcaccggcttcctcatgaacatcatcccgacgacgcttgtcggcgcctttgccgagggcgacatcctccaggtgctgttcatctcggtgctgttcggcatctcgctcgcgatcgtcggcaagaaggccgaggccgtcgtcgatttcctgcacgcgctgacgttgccgatcttccggctggtggcaatcctgatgaaggccgccccgatcggcgccttcggtgctatggcgttcaccatcggcaagtacggcgtggcatccattgccaatctcgcgatgctgatcggcaccttctatctcacctcgttcctgttcgtcttcatggtgctcggcgcggtcgcacgctacaacggcttctcgatcgtcgcgctcatccgctacatcaaggaagaactgctgctcgtgctcgggacgtcctcctcggaagcggcgctcccggggctgatgaacaagatggagaaggcaggctgcaagcgctcggtcgtcggcctcgtcattccgaccggctactccttcaacctggacggcaccaacatctacatgacgctcgcggcgctgttcatcgcccaggcgaccgatacgccaatctcctacggcgatcagatcctgctgctcctcatcgccatgctgagttcgaagggggcagctggcatcaccggcgctggcttcatcacgcttgccgcaaccctctccgcggttccctccgtgccggtcgccggcatggcgctgatcctcggcatcgaccgcttcatgtccgagtgccgggcaattaccaacataatcggcaatgcggtcgcaacgattgtggtggcgaagtgggaaggcgagcttgccccggcgcagcttgcaaccacccttgcaggcaaggcgccggtggagaccatgtcggggttgtcaagccagcggagtgacactgttgaactcggacaaaaagtgctgtttggtgcaaccaattccgcagatcgtactcttgccggtcgcccaggggggcgcgattcccgtcgaattgctcccgatcattccgctcaggtcttcggcggtccgctaagcttatgagtgacttaaggagaaagcgagtgaagaccaaccccatcccggatcatgttccgcccgcactcgtgcggcacttcagtctcttcacgtcgcctggcatggcgccgacgcctaacggggatccgcacgccgccgtggcttgcgttcatgatgatggcccgccgatcttttactctccttccaacacgcgcgatggacgaggtacctgggtgataacacgggcgagagaccagcgccgggtccttgaggatacagagaccttttccagccatcgcagcatcttcgcctcggcacttggcgaacactggccggtcatccccctcgaattggaccccccggcccatggagtgtttcgtgcactgctaaatcctctgttctcatccaggcgggtgttggcgctggagccgactatccatgccagagcaggcgcgctgatcgactgcattgcgaaagagaagaccagctgtgacgtgatgaaggatttcgccttgccctttacgttcagcgttttcctcagctttctgggactttcccagaggcgatccgaagtacttgtcggctgggtaagcgatttgctccacggcaacgcagaaaagcgaagggcagcagcccgctcggtcgtggcctttattgacgaaatggcagcgatgcgccgcaagtcgccagctgtcgatttcatgaccttcgtcgttcaggcgaaaatcgagggccgctccttaacagaagaggaagtccgcggcatcggtgtgcttttcttggtcgcggggctcgacacggttgccgccgccattggctttgacatggcctatcttgcacgcaatccaaagcaccaggagttgttgcgaaacgaaccggctcggctcgggctcgccgctgaggaactgctgcgcgcctattcaaccgttcagataatccgcgtggccacgaaggacatcgagttcgaaggcgtgcctatccgtgagggtgattatgtttcctgtcccgcgatgattgctaatcgagatccgtctgaatttaagtgccccaacactatcgatctggcacgacaggataaccagcacaccgcctttggctatggaccacacctttgccacggagcgcatctcgcacggcgagaaatcgtcattggcctacgtgaatggttagcgcgcatcccagctttccgcatcaaggaaggtacggcgccgataactcatggcggccatgtattcgggatcagtaatatcatcctaacttgggcctgattggacgggcgaggcggtagcaatgaagcgccgatcgctcccaggtcttcatcgcttaccgcatctcaccgcaccatgatgaatgaagaaagcataaccaatctattcgaccgagaagcaatccgcgactgtctccatcgctactgtcgagggatcgaccgggcagacgaggctgcactgcgcagctgttattggcccgatgcgcgtgacaatcacggaagctactccggctctgccgcagggtttattcagcatgcactcaacgtcttcaaaactaagccgcgcaacatccaccagcttacgaacataatcattgagttcctgggcgcgacagaggccgccgtcgagagttatttcaccgcgctgcagcgcggtcacgacgcaacaggcgagataaagcaggtgctcttgtgcggccgctactgtgatctgtttcagaaaagggaaggggagtggcgcatcgtcgaacggacggtggtctatgattgggttgagaaacagagaccaccgaagtcctcggaagcagagcggttcggtcctcgccaaccgattggggcaccgcatccgaatgatcccgtttacgaactttcgaagcggcgagttgctgcgaaaaatcatccaaaggacctgatcggcagtggagaagaagaaccatgatacgactgcgctaccctccgattcctcgaggccgagcccgcggagcaaagagacgcatggacgatcgccaggttcagccagggcgggtcatcgtcgtcacaggtgccgcagggggtatcggccgcgcgctcgtcgatatttttgccgcgaatggagatgtcgttgtcgcggtggacctcccggacagcggcgtaatcgaacttggccaaaatctcggagagccccatcttggcctcgaggttgacgtgtcgcgagaggacgatgtcgtcgcattgcgtgcccttctggaaaagcgattctcgcggattgaagtgctcgtcaataatgcggggattgggccgaccatggctgcgaccgccgatactgctctcgaagattttcaacgcgctctagcgataaaccttgtcggggcttattcggtggcgtgcgaaaccgcgaagctgatgaaacctggcgccgccatcgtcaatgtcgcttcgctggctgggctgctcggcaatccgaagcgcagtgcctacgcagcttcgaaagcaggtctgatctcaatcacgaaatcgctggcgtgccgatgggcatcgcgcggcatccgtgtgacagcggtagcgcccggtcacgtgcgcacgcctatggttgccgaattggaacgcgctggcaagctcgacgtcagcgcgataaggcgccgcgtaccgttgggccgaatagcgcgccccgacgaaatcgcgcgggccgtgcgctttttggcgagcgcacaggcgagctacataaccgggtcgacgcttgtggtcgatgggggctggatgtcagtcaaccaaccgggtggtgcccatcaggctcaggataggacgcccggagcagaattcatgcggccggtcgaggacaccgatgcgcgaacagtgatcgtcatgggcggcgctacaggggtaggcgcggccatcgctcggcgctttgccgaaaacggcgacacggttgtgatcgccgacggagacggtgaagaagcggtaaagctcgccggcttgctcggcgacaagcacctgtcaaggcgcgtggacaggaccgtcgaaaccgaggtagtctcgctcttcgaagaattgcgggagcgcttcggccacctcgacgtcttcgtcaacggcatgaatgagatactcgtccccaataccgaggagtcgccggaagtcctcaaacgcatactggatgtcaatcttactggcgccttcacctgcgttcgcgaggccgccatatcgatgcgctctggcagcgtaatcctgaatctcggggcaagtttaagcctttcaccgctcgcgccaagtcacgcctatggcgcatacaatgctggcatagacatgctgacccgctgcacggcggccgaactcgggccattgggcatccgcacagccacagtcgctccaggttacatccgcacatgtgccgccaaccggctggcagcggtcgccggcatggattcggcttcgctccgacagcgaattcctttgggcagggtcggggacgcagaagaagtcgccgaggctgcctactttctggcctcgtttgatgcctcctacatcaacggctcgatcctgcacgtggacggaggcttgatctcgtccagagaagcggggtggggcagcgaagtcgatggagcaatttcggcggagatgaggccgcagcgccgacccgcggcgcgatggcggttgctctctccctgaattgcatttgcacgcttttagcgcttggcgctctgaatgcgttaggaggccatgagcagggccatagggaaaccttctcgtcaatcgaggcgcgacccgcgactgcgcgattccagatccgaaaacaaggagacaccatggagttcgcaacgttcattctcgctgcccagcgcggctatcatcagtcttccgctagcgtcatccgcaactcgatagagcaggcaattctttcggagcaggctggcttcagcacagcctggttcgccgagcaccactttaacaactacagtctcgtcccgtcgccactactgatggtagcccactgtgccggattgaccagcaccattcgcctcggaaccgcagtctgcgtgctgccgctctaccaaccacagcgcctgctggcggaaatcggctttgtcgacgtcgttgccaacggtcgactcgaactcggcgttggttcgggataccagcagttcgagttcgaccgcttcggcgtcaatatagatgaggcgccggccatcttttcggaatgcctggacattttgctgaagggactaaagcaaaaaatcttcacccacagcggtcgctacatgcagatacccccgacggcgatttcggtgcgcaccctccaaaagccgacgccaccgatctggattgctaccgcatcctccaaaactatggcccgagcctatcgtgagggtcacaatcttttcgtcacggctctccatgacggcttggaaactctgggcttgctgcgtggcatcattaagaccgccgctggatccgagggcaaggaggttcgcgactccaaggtatcgctactgcggtgctgctatgccagtgatgatggagcggaaatcaacagctatatcgataacgcccgcttccagcgccggctgtccgaggcactgcaacagcgtcggcaacaaagtaaggacggctatatgttggaggagatgccgacgcatcaggatctatcgttcgatactatgcgcaagaacctgcccattggcagcatcaatcgcgtgattgatcgccttctggaggagatcgatgtcttgaagccggaccagattgcaattcagacccagctgggggattttgaccaaaagacgatgttgcgccagatcgagctttggggagacaagataatcccggcagtccagaaatctctcgggcggtcggaggcttgagtttatatcgtcctgaccttcgggtcagctcacttcctcaggcgccgtcagaatgcccggcaagttttaagagccatcgtaaatgtcggcacagattacagctgaactcctcgtgaaagttgggcgtcatgggccgcatacccattcgcacgacagacaagcagcctaccggcggccgtacgcatttgagctccgatagttcagtccgcgattttaatcggacgaggccctgaaatacccatcttaagttgatcggacggcggacacttagtgctggcaaagcctccgagaagatgcttcccaaacccgcggcttgtacctgatcggcggcagtgggctccgagcgcctgataggcaacgctatgcgacaattgctgggtacaattgtcggctccgcgacacatgcttgcgttttaatgcgggcgctctctttttggtctaagcggctgagaaatctggaaaatcgggcagccaaccgctgcgctccaccgacttggcacggcttttgaagccttccttgtgcaggcggcttgaagctgccgctgtattcgtgttgcgggcaaccgcgatggtttcgaacaacgaaggaaagcaacatggcaggtctgcgtcaaatcgcgttttacggcaagggcggtatcggcaagtcgaccacctcgcagaacacgctcgccgcccttgtcgacctcgggcagaagatcctcatcgtcggctgcgatcccaaggccgactccacccggctcatcctcaacgcgaaggcgcaggacacggtcctgcatctggcggcaaaggagggatcggtggaagacctcgaggtcgaggacgtgctcaaggtcggctacaagggcatcaaatgcgtcgagtccggcggccccgaaccgggtgtcggctgcgccggccgcggcgtcatcacctcgatcaacttcctggaggaaaatggcgcctatgacgatgtcgactacgtctcctacgacgtgctgggcgacgtggtgtgcggcggcttcgcgatgccgatccgcgagaacaaggcgcaggaaatctacatcgtcatgtccggcgagatgatggcgctctatgccgccaacaacatcgccaaggggatcctcaaatacgcccattcgggcggcgtgcggctcggcgggctgatttgcaacgagcgccagacggaccgcgagctcgatctcgccgaggcgctggcggccaagctcaattccaggctcatccacttcgtgccgcgcgacaacatcgtccagcacgccgagctcaggaagatgacggtgatccagtatgccccggagtcgcaacaggcggcggagtatcgcgcgctggccgacaagatccatgccaattccggccagggcaccgtcccgaccccgatcaccatggaggagctggaggacatgctgctcgatttcggcgtcatgaagaccgacgagcagatgcttgccgaacttcaggccaaggaagcggcggcagcggcccagtgaccgccgccgcagacgctgcccgggacggtgatccggtgcgacattccaccaatggtgcctcttcttggaggacacgcaaaaaagggggcaggcccaatgagcctcgattacgagaatgacagtgcgctccatcaggagctgatcacgcaagtgctgtcgcagtacccacacaaggcggccaagcgtcgccaaaagcacctcagtgtcgcatcggaccgcgaggcggtcggggaggagggcgagaccctctccgaatgcgacgtgaagtcgaacatcaagtcgatccccggggtgatgacgatccgcggctgcgcctatgcgggctcgaagggcgtggtctggggcccggtcaaggatatggtccacatctcgcacggcccggttggctgcggtcaatattcctggtcgcagcgccgcaactattatgtcggcaccaccggcgtcgacaccttcgtgacgatgcagttcacctccgactttcaggagaaggacatcgtctttggtggcgacaagaagctggaacaggtcatcgacgagatcgaggagctgtttcccctcaacaacggcatcaccatccagtccgaatgtccgatcggcctgattggcgacgacatcgaagcggtgtcgcgcaagaaggccgccgaacacgaaacgacgatcgtgccggtgcgctgcgaaggcttccgcggcgtctcgcagtcgctcggccatcacatcgccaacgacgccatccgcgactgggtgttcgacaaggcggacggcaagacggacgtcgagttcgaaaccggtccctacgatgtcaacgtcatcggcgattacaacatcggcggcgacgcctgggcgtcgcgcatcctgctcgaggagatcgggctgcgcgtcgtcggcaactggtcgggcgacgccacgctcgcggaagtggagcgggcccccagggccaagctcaacctcatccactgctaccggtcgatgaactacatctgccggcacatggaggaaagatacgccatcccctggatggaatacaacttcttcggcccctcccagatcgaagcctctctgcgcaagatagccaggcatttcggcccgacgatcgaagaacgggccgagagggtcatcgccaagtaccggccgctggtcgacgccgtgatcgacaagtactggccgcgcctccagggcaagcgagtgatgctctatgtcggtggtttgcgcccgcgccacgtcatcaccgcctatgaggacctcggcatgcagatcgtcggcaccggctacgaattcgcccacaacgacgactaccagcgcaccggccactacgtgaagacgggcacgctgatctatgacgacgcgaccagttacgaactggacacgttcatcgagcggatccgccccgatctggtcggctccggcatcaaggagaagtatccggtgcagaagatgggcatcccgtttcgccagatgcactcctgggattattccggcccctatcacggctatgacggcttcgccatcttcgcccgcgacatggatctcgccatcaacaatccggtctgggatctctacgacgcgccctggaagaaaatgaccgtgccgacggccgcagttgcagccgaatgatcggccggtcttgcgcggcacgaggaccgcggcaagaccggaaacctctcgaacatccctgggcctaagaggccagatcaagaaggtcaaacaccatgccgcaatcggctgagaagatactcgaccatgcgccgctgtttcgcgagccggaataccggcagatgctcgcggagaagaagctgaacttcgaatgtccgcaccccgaacggctcgtcacggaccagcgcgaatacagcaagggctgggaatatcgcgagaaaaacctcgcccgcgaggcgctcgtcgtcaaccccgccaaggcctgtcaaccgttgggggcggtgttcgcagccgccggcttcgagcggacgatgtcgttcgtccatggcagtcagggctgcgtggcctattatcgctcgcacttgtcgcgccacttcaaggagccggcttcggccgtttcgtcctcgatgaccgaggatgcggcggtgttcggcggcctgaagaacatggtcgacgggctcgccaatacctacgcgctctacgatccgaagatgattgccgtctccaccacctgtatggccgaggtcatcggcgacgacctgcatggcttcattgagaacgccaagagcgaaggcgcagtcccgcccgaattcgacgtgccgttcgctcacacgcccgccttcgtcggcagccatgtcgacggctatgacagcatggtcaagggcatcctggagcacttctggaagggccaggcgcgcacccaagcggccggcacgatcaacatcatcccgggcttcgacggcttttgcgtcggcaacaaccgcgagcttcagcgcctgctcaccctgatgggcgtgtcctacaccttcatccaggatgcctccgaccagttcgatacgccgtccgacggcgaataccgcatgtatgacgggggcacgacgatcaaggcgctgcgggcggcactcaatgccgaggcgacgctgtcgctgcagcactacaacagccgcaagacgctcgaatattgccgggaggtcggtcaggccaccgccgccttccattacccgctcgggatcaacgccaccgacgcgttcctgatgaaggtgtcggcgatttccggccgggaaatccccgagacgatacgcctggaacgcggccggctggtcgacgccatggccgacagccaatcctggctgcatggcaagacatacgcgatctacggcgatccggacttcgtctacgccatggcccgcttcgtcatggagaccggcggcgagccgcggcattgcctcgccaccaacggcacggcggcctggcaggccgagatgaccgagctgctcgcctcttctcccttcggcaagcaggcaaaggtctggccgggaaaggatctctgggccctgcgctcgctgctcttcaccgagccggtcgacctgctgatcggcaattcctacggcaagtatctcgagcgcgataccggcacgccgctgatccggctgatgttcccgatcttcgaccgccaccaccaccaccgctttccgctcatgggctaccagggcggcctgcgcctgctgacgacgatcctcgacacgatcttcgaccgcctcgatcgcgaaacgatgcagacggcggtgaccgattattcctatgacctgacccgctaagaacggcggtcggcaaaacgccggccgtctcctgatgcaatctggagattagcgaatgtcttcgctcaatgtcaaaatccaagatgtcttcgatgagcctgcctgtgagagaaatcgcagcaaggattccaacgcgcgcagtaaaggctgttcgaaaccgctgacccccggcgcggcggccggaggctgcgccttcgatggcgccaagatcgtgctgcagccgatcaccgacgttgcgcatctggttcatgcaccactcgcctgcgaaggcaattcctgggacaaccgaggtacggcgtcgtccggtccgacgctttggcgcaccagcttcacgaccgatctcaccgagcaagacatagtgatggggaacagcgagcggaagctcttcaaagcgatccgccagattagagaagcgtatcagccgccggcaatctttgtctatgcgacgtgtgtaacggcacttatcggcgacgacatcgaagcgatctgcaagcgcgctgaggaaacgtgcggcctaccggtggtgccgatcaattcgccgggcttcgtcggttcgaagaacctcggcaacaagctggctggcgaggcgttgctcgaccatgtcatcggcacggtggagccagatgatgccggcccttgcgacatcaatatccttggcgagttcaacctgtctggtgagttctggttggtaaagccactcttggagaggcttggcattcgtgttcgcgcctgcattcccggtgacgcccgctatctcgacattgcctccgctcatcgcgctcgagcagccatgttggtgtgctctacggcgttgatcaaccttgcccgcaaaatggaggagcgctgggatatcccgttcttcgagggatccttctacggcatcaccgccacctcggaagcacttcgacagattgccgatctgctcgtaaagaagggtaccgatctagagatcctcgaccgcaccgatgcactcattgcggaggaggaggcgattgcgtggaaaaagctcgaggaataccggccgcgacttaaaggcaagcgggtgctcatcaacaccggcggcgtgaaatcctggtcgcttgttcatgcgctgatggagatcggcatggagatcgttggcacctcggtcaagaaatcgacggtcgaggacaaggagcgcatcagacaggtgcttaaggacgatctccagatgttcgagtcgatgtcgccccgtgagctctacgccatgctctcagaacataaggccgacatcatgctgtcgggcgggcgcacgcaattcattgcgctgaaggccaagatgccctgggtcgatatcaaccaagagcgtcaccgcccctatgcgggctatgacggcacggtggaactcgtgcgccagatcgaccttgcgattcacaacccggtctggtcgcaggtgagggagccggcaccgtgggaaagccgtcctgccacacaggaaccactgccgaacacgcgccccgacaccgatgctacgagtgtcgggcgctcaattcgccggcacgacgccggtgacttcgttgagtgttgaggaaagcaaatggtccacatccatcgccaatctaaatcagcgacggtcaatccgctcaagtcgtcccaaccgctgggtgccgcgttagcctttctcggggtcgatggcgcgataccgctgttccacggcagccaaggctgcactagcttcgcgctagtgctgtgcgtgcgccatttcaaggaaacgatcccgctgcagacgacggcaatggacgaattggcaacagtcttgggcggggcagcccatctggaagaggcgattctgaacttgaaaaagcgggcgaatccgcggctgatcggaatctgcacgacggcacttgtggaaacccgttctgaagatttcgcaaggcaaatcgccaacatcaaaatgacgcatgcggaggaacttgcaggcacagaggtcgtgctggcaaacacgccggatttcgatggcgccttggaggagggctgggcgagggccgtcgccgcgatgatccaacagattacactgcggcgtcagcaggcgcctcgctcgagaaaggcaacactgatcgagaggattacaaaacctagcgagcagccgtggaagcaacagaaggttgcgatcctgccgggatggcacctcacggtaggcgatatcgagcagttgcgcgagatggtggaaggtttcgggctgaggccggtgatcgtgccggacgtctcaggctccctcgacggtacggtgcccgaccgctggatgccgacagcgtatggaggtacaagcatcgaggatatacaggagttgggtagggcggtgcggtgcatcgccatcggggaacatatgcggcgcccggctgagctactgcagacgttgacgggtgtgccttacgtgttggtccagtcgctaacgggattgaagaacgtcgaccagtttgtctcgcttctttccgagatttcctgcgtgccggcgccggcgaagatccaccgtcaccgctcacagctgcaagacgcgcttctcgacggacacttccatttcgccggcaagaagatcgcgatcgccaccgagccggaccagttgtaccaatttgccaccttttttacgggacttggcgccgagatcatctcggccgttacgactacgggtgagtcagaaattatcgagaaagtcccggccgaaaaggtccagatcggcgatctcggtgatctcgaagatctagccggcggcgctgatcttctcgttacccattcgcacggtcgccaggcagcggagcgcctcggcatccctctgctgcggatcggcttcccgatattcgaccgcctcggcagccagcacaaactcacagttctctatcgtggcacgcgcgacctgatcttcgaggcggccaacatcatccaggccaaccagcccgcgccgtcgcttgagcaaatcgatgcaatgcgaaagcggagaaatgccggatgaattccgttcgtcgcctctcgctcgtcactgacgaaatccagccgcggcgttccggcgcattgcgcatagcgatcgcgacgcaggacatgaaagtcctaaacgcccatttcgggtcggccaagcactttgcagtctacgacgtgtcgcgcgacggctgggatttcgtggaagctgtgagcttcgatgacgtctccgacgaatccgggaagcatccgatcgagggcgaggaccgcatcaccccaaaggtgaccgcgttgacaggctgtcatctcctcttttgtcgggctatcggcggcccttccgcagccagggtcgtctctgcgaaaattcatccgattagagtgggagagccggaagccattcaagacgtactttcacgaacccagaaaatgctcaagacggcccctccgccgtggttgcgcaaggtgctggcgcaagcaggcgtcgcagagaaaaaaccattcgaggacgaggactgaatcatgaaaaaaacgtccatcaatacgggcacgcctgatgtcaaggtggacgaggcggcccttgtcacgccatttgtcaaatgcctcgcgcggctggtccgcgcgcaggatacctacggatcgcaggaccgcgcatcggacgcggagttgttggcccacttcatcatcactgaagagcagcgtcgagaaatcccgatcatcggcgatcccggtccggacgtcatgttgcggttcaatatcttttataccgccgtcgcgctttcaatcgaagcacgtaccggtttggtagcgtcgccgatcacgatgatcagccatgagggcttcggacgagtgcttctaacgaccgggcggctggtcgtattttcgaaaacagtgcgcgacatccaccgcttcggcttcgcgacacttcgcaagcttgcggaagccggcgcaaagctggtggatgatgcgacggccgccattgaaacctatcccgaagtggctcgggcctgacgatcgatccggcaaaaggcatgctgccggcgccaaggcgaccggccaaggattagggctacgcccgtgggcggcttgagggcgagtaaatagtggatttttccgaaacggagggtatgagcccgtgcatcaacctcagcgacgcgcgccgccgtctgccccgggcagtttatctgtaccgcttgagtactcgttcggtagccgccgatgagaaccatgtgtagtaattcaaacagccgcttcgacactcttgtcggtaaagcgacacattcttgtcgactgttcccttctctgcctcccggctaaatgcctgaaatgctaacataacaagcttcttttcaagtcgagcacccgagtggcacgagtcttgccgacatgccatctaagaggctggaaagccggggatcggcagggtacgaatgaggcaagcaacgtggcaggtctaggtcagatcgcattcggctgcgagggaggcatcgacacgtgcaccgccgcccagaatacgctcgctgttttttttgatctcggaccgaaagtcggtagtgtcggccgcaacctgaagagtaactccggccgcttcatcctggaaccaatgccgcgggacagcgcgccagcgtggtacgcgatcatccgcgatttcgatgcggacgtgccgtggaggctcaaagctttccacaccgccgccgggcttgcgatcgaaccgtccgttcgctccgtgtacgagggcttcgcggtgcttctcacgaccgggcagagtcgtatcgaccgaacaccatccgtcagtcttccaataggaagctcgctggagaccgaagcgataaccgccatccacgcacccaagtggcgcggttgacggtcgatctaggcgatgacgaaccgccggctctcatttcccctggagagccgacgtcaggcagcgggaccactcctccccacgcgcaccggtcccgctgccgcgatctttccacagggcgaggctcgaaatgcctagccaagtctttgcaatggccgctgactagcagaccgcccccgaaaagtcggccgacaagaccggaatttcggcggatgtgacggatgaggtcacgtccgatctcggaagagattttacttttttgcctgtggcggatgcggagagacagatcctgattggagaaccaacgatgacaagtcatttcgttacccgcgacggctccacatggatgccgcagtatctgacggccattgacgccatgacgtgcattggttgcggccgctgcttcaaggtctgctcgcgcgaggtcatgcatctgcacggcatcgacgaatccggtgagatcctcggggcctgcgatggcgaggacgacgacttcgctggcgagctcagtcgcacgatcatggttgtcgatcacgccggccgctgcatcggctgcggagcctgcgcccgggtatgcccgaagaactgccagacccatgtagcggccgacgaaattgttgcttgatctgacgaacggactccggaaaacgactttggccgttataaatgcgatcatattcgagacgacagtccccaaagagcccttgccgtcgcgcaagctgacgaaagacgtagacatcgccgaccgtcggccccgtcccgcagctagcagccgacgtagaacaacgaactgcccagccacctgaaagccagagtccgccgaacttggaatgagacagaattggcacaatattgatttcctcgcgtgattcagggtgaatccctgccttggagtcaagaggcaattggcgcccgcgggcactcagagaggaccttcgaatgccccgttggcatcggtcagcaacggaatgcgtcagcagcctgagcgatcagcagttaggttacaaaagcactgctgctcgaagcgcacatgccgacgcaaattggtgaagaaaccacggagcatatagcccgctgcctccggattgacagtagcatccgccgtcgccagccgacccaacacttccgccaattcctcggcgaagcattcgtcttcgcaatgctcatacttgagcagacccaaagtagttaaaactgatggatcgtcccctagcttctcctctgtccacgcgaaaacagcagcttcttctctctcgtgaagattccgtaagtgcgggccaagcatctttccggcgtgagcgcatatactacggtcgactccgtgcggaaggctgtttgcaatggcctcgagacggtcacagagagacagttggtcctcgtgcgaacctgccaataaggccagccgctcggcggtggctggagctaatgaccggtttgtggggggcgcaaacgtcttgatcctagcgatcatacactccaggccctttccgtgctttctctaaggtaatcttccgtgctcaaggatgaggtaatgcgtggtgcggggccttgacttgaatcaaggtctatcggcaataggactaaataatcatctcattgtctgatggatcgtacgcggcgtttccccccaagcgctctgctgttgtgagatcgccatgagcacgtcgggagtcccagctaattgtgagacgctgatccgttgtgcatggacccacggcatgagcgcgtcgatgtctttggcgagtggcggttggcgatgccgatgaagaaattggtagactgggttcaacaccattcatcttgcaaatcggacccagctaccattgccttgatcatggccggcacagagagcgcattgcggcgcttgggtttcttatcggctttttcgacgaagccctgcatgtcgcagggagagccttggcggacacgaatatgcggcgccgcatagacccaggaacgcagcaataacacgatcggcaggcgtgaacaggaagtatggcacccctatagtgccaatgaccgcccggaaccatgtcgggcgggaccgagcgagctcgcctactcggcagaaggccagcctctacggatcgccgcctgtcggttttggacgcggcggtccacttttagccgccaggctgtcgttgttcgacatacgacaatgttacaatgccgacatagctagttcgatccaggtacttgaatttaaacgggttttccgtggcacgtatcttgctctgctgacgtgtcagcgtcgacgagaattgtgcggagaatgtcgaaatgtcagaaccgttctttaggccggggtcggggcccgcgcccggccaccctactgcagaaccttggagaagaaggaagaggtggtactcgccaagcgatggtcgagctggcactgcacggtcgcatttgccacagcggtcgacgagccatgatggagtgtgttcgcgtatctgtgcatttgtcctatgtatggtcgcactgcaatttctgatgacctcagcaatggcggccgacgagagcccgcttcgcgaagccgaggttgcaaatttcatgctgggcaacggcatggaggtagtcgtcatacccgatcaccgggcgccgatcgtcacgcagatgatctggtataaggtcggcaatgccgacgagccacccggcaaatccggcattgctcatttcctggagcatctgatgttcaagggaacgaagaagcatccgtccggagagtttagcgcaaagatcgcggagatcggcggtgaggagaacgccttcacgggttccgactacaccgcctaccatcagacggtcacgccagagtcgctcagaacaatgatggaattcgaagctgaccggatgcgccatctcgttctcaccgatgcggtgatcgtacccgaacgcgatgtcattcttgaagagcgacgctggcgcgtcgagaacgatccggagcagctacttgaggaggagatgcaggcgaccttgtatcagaaccacccttaccgcatcccgacgattggctggatgcatgaaatggaacagcttaatcgcgaagacgcactaaagttctatgaccgctactatgcccccaacaatgccattctggtcgtggcaggcgacgtggacgccggcagggtgcggcagctagcggacgagactttcgggaccctgcctcgcggtccggatctgccggcgcgggtgaggccgcaagagccggagcagaacactaaacggatcgtcgcgctcaccgacccgcgcgtcacggtgccgagcttccaaaaatcctgggtaacgacgtcctacggaacagccgagcagggcgaagcggaagccctcgatatcctgtcggagattctcggcgggggaacgcgcagccggatctatcaggagctggtggtcaaacaggcaatagcctcctctggcggggcctatttcaacggaaggtcgctcgatccgtcgagcttcacggtttttggctcgccgcgcggcgaggcgaagattgaggaggtggaggatgcgatagacgctgaaattcggaagatcatcgagttcggcattaccgacgtcgagctcgagaaggccaaaaaccgcttcgtgcgctcgataatcttcgcgcgcgacagccagtcgggaatggccggcatttatggggcggcgcttgcgacaggcgatactgcacacgacgtagaggcgtggccacttaggatccgcgccgtaaaggcggcagaggtgcaagcggctgccaggaaatacctcagtcccgaccggtccgtagcggggtatctgctgccccgcgaaagcgctacctcaggagataaaagccgatgatatcgttcagccgactgcgcatcggggccaagccctcactcgtcgtggcatgcatattgctgggccttgccgcgtgtccagcgcttgcgggcatggccatagaggaggtcgagacatcgagcgggataaaggcgtggctggtgcaggactattcgctaccgatcgtcaccacccgcttcgcatttcggggcggcaggacgcaggatccatctgggaaggaaggcattgtgaatctgatcacagagctgttggacgaaggggccggtaatcttgacagcgatgcctttcaggagcggctggacgatgctggcgccgagatgctctttgaggcggggcccgatgcagtctacggcaatatgcgggtgcttgcggagcgaaaggatgaggctttccaacttctccggctggcaatcgagcagccgcgcttcgaccaacagccggtggaccgccttcgtgcccaaatcgtctccagcatcctggcaagagccaaggatccggagacggccgcacagttcgcatggatgagggcgatctatggtgatcatccgtattcgcgtcgggaggagggcaccgtgcaaacacttgccgctgtcacgacctccgatctgaaggcggttcatgagcggattttcgcgcgcggcaaccttaccattgccgtggtgggagcgatcgatcccggcacactcaagcgtgatctggatcgaatattcggcggattgcctgctggcccctccctaacgccggtcgttgacgcagtgcctaagctggggcgcgccattcgcgtcgcgtatgacttacctcaggcccaactgagcctagcttacccgggaatcccccgaaaggacccgcagttctttgcagccaatctcatgaaccaaatccttggcggaggcgcgttcacatccaggctctggaatgaggtgcgcgagaagcggggcctcgcttacggcatttactcaaccttggagaacatcgaccatgcttcggcgctcgtcatcggcaccggaacccgcccggatcgggccgcagagacgctctccctcatccaagccgaggtcaggcgaatgtcagaggagggcgtcagtgaggacgagctcactgcggcaaagaaaaagctcatcggcggttatgcgatcgaaaatctgaactcatctagtgcggtcgcccaaacattggtccaaatccaactcgaagatcgcggcatcgagtacgtcgagcgccgcaaacaactgatccaggccgtcaccgtggaggacgtacgggcagtcgcgaaacggctgctctccgccgaccccaccgtaatgactgttggaccgtccctcaagggaacgaaccgatgaccgtccaaaggaaagctaggctggcagcgtccggccgaccttctccaacgccccggcgcggcactaccttgggaggggggtagtcaagatcacctctcgcggtcaccagatgttcagttccaggctctatgcgactcctgaagcagcaagggagtgcatcgcagcctccctccgcccgacggcaggagagaatgtggtgtctcggcgaaaacaggcgaatgctctctagcacgactgctcctgcgatgctggtgacctgctggcaacgagactgcttgaccctgcagcagcggttctcgcgtcactcacgaaagcgcatcagcaccaccgctaaggcttcacacttgaagcataatccgaatgtgcttagggtggccgccgaagactccagatgtctcaattgagtttctgactttcagttgaggtgtgttaaaggagtgtaggtgcgggaggtggagctcatatcatatctcccgaagaactaagatagccgaaattgaggagacgaatgtgctgagtactaactctgaacaaacaagacgtaagccaaacgctgtggatgcccatgtcggtcaacgaatccgccagaggcgtgagtggcagaacatgtcccaaacgactctcggcgaagctatcggggtgacgtttcaacaggttcaaaaatacgaaaagggcgtgaaccgcgtcggtgcgggtcggcttcagcagatttcgaaggctctgaaagtggagccttcctacttctttgaggatacgcttaataaaatccggtcggaggagcggtccgcttcaaatcagattaacatcccacccgaagtcgttgaattcgttgtaagcaaggaagggatcgagctcatcagggccttttctcgcgtgggcgactatcgtgtgcgccgccgaatcgtgatgctggtcaagtctttgggcgcacacgagcggtgatgtatggattgggccgcttctgtgtggagacagagtgtctctataaagtcggacaagcaccaccgcactgggaaatgagtcaccagtctgtccgatactctcgtacggccctttaccctttaaacgtcctgaaataccaaggcgatactcgccgatcaattctccgaatcttggcgggctgagcggcgcgccggtccttcgggatactgcggcgaccatcgactgcgagcttgaggatctcatagaacgacacagccatgcgattatgctcggccgttttgtcgacatttgcaagggcaacggtcgttcattggtctatcgtggcggccgatatttgcaattgccgggtagcgttataggcaaaatcgctccgggactcaccgcactgaaaagctattgaacgtggtttttgcgcaagcctgtctatgatctcaatcaattcatctgtagttcattcgtgctagcttgagcgcagccttagttgccgaccacgatccgacttgaagcgagcgatgctttctacaccggtttcaccggtcagagcggaaaagaagagtccagccggccccgatttcctattctgagacctcagaacggagatcgagatcttttcatttgtagcctgccgcggaatgggcgagcgctgacctgagttctcagggtcagctaggcaagcgccggaatacgactggacgtgatcaatcgacgtcagaagctatgggatgttggagaagaaatgcgtaggttgcttactccctggcgcggtgtcgctgcaggctttctgttgaacgggatcctcctcgggacctgggcttctcgcgttcccgccgtgatgggtcactttcacgttgccaaagcgagctttggggttttgctgttgcttttagggttgggcgcattaatttcgttccccattaccggaaggctgtccgatagcttgggtgcagtgcgggtcgcccgaatgatcgcgatcccgttcctggtttcgattgccgctctagggcttgcgcccacaataccgctgctggcgatcgccctatttctctttggcatgtgtcatggctcgatggacgtagcggtgaatagttgggcgagcgaagtggagaaacacatgggacggccagtgatgtcgtcgtttcacgccatgtggagtgtgggggccgttctcggcgcagcaggcggttacattgctacagtctttcagaccccagtgtacgtccattttcttgttacggccgtgacgatcggcgggttgctcggacccttccttctgctcgattggcaatcaaccatccgaacgcatgaaagtggtgcagtgggattggtgttacctaacagtggcctttttcttgtggggctcattgctctcgcctctggactaggagagggtacagctctcgactggagtgctgtatatttgcatgatgtagtcgggaccgaagaatcggacgccgccttggggtacatgggcttttctgcggccatggtgatgatgaggcttaaggcggattctctggttacgcgatggggatcagccactgttgcacgcataagcggtttctcggctgtctttggcattttgttgatcgtcctcggtgaaaccttgccgttagtcgtggcgggcttcgtgctgatgggggtcggctatgcggccgtcctaccattggctttcagtcgggcagcggccgatcttgtagtgccggcggggaaagccatcgcgtccgttgcaatcttcgcatatggcgcaatgacgttgggaccctttgcaattggactcctcgccgaggcagccactatgcgtttatgcttctttatcgtcggactatttgcagccttggtggcagtattggctccagtgctcaagcaatagaacaaatcaccccctgctttatcgcaccttgagagattttagcgttttgtccatgagagcgacgaatactccgccttttgctgaccgaggccgcgagtattcttcatcggcaggcgcggaacggaacggttggagatcacgccgacgccatttttgaaggcatgggtgaaccaggcatgaaatggatcgaggtgaccggccgaggccagcggcggtatcggactgacgaagatgagtaatcaaaagtcgataaagcgttaattcatatcatcaatggctgcgatgaaaacaaatgattttactgaatagatgcgggcgaaatagaagaacgctcatcaagttggagtcagtgaatgtgcggcactgttagcccaactcgcgttgactgtcggacaaagcgactatcctctaggaattgaatggagagaactatgtctgatgcaaagctgcaacgcgtactttcgtctcttacggaagtgtacagacagctaaattctctgccgtccagtcagccatctgacgccggctatgtcaaactcgatacaaacgagaatccatttgcgttgccaaaagcggtaatgcagagcgcagttgctgctctcgagcggcagtatttatatccagaggatgacaacatcagtttgcgggaagccgccgctgcgtcctatgatctttccgcggatcaggtgatcgccggtaacggttcgtccgaacttctttcgctcatatataaagcattccttggtccgggtgacagtgtcgcgatgctgtcgcccggctttgcatacaaccgcaagctcgcccagttgcaaggtgctcgattacttgaaatcaaatggggcgagtcgtccttgttgccgatacacgaattgctcttcggtcctgcaaagcaggcaaagttcatcctgctggctaatccgaacaacccgacaggaacatttgtcccgattgctgatattgaaagcctcgtcgcactatctgaccagttggtggtactcgatgaggcctacgtggacttcgctcccgacagcgctctgcgtctcgttaaccgctattcgaatcttctgctcttaagaacgttttcgaagagctatgcggcggccggcattcgcgtcggcttcggcttcggtcatcctgaggtgatagggaggctgcgcaatatccagaacatgttcaatatgaatgtgatcggccatgcggttggcgtcagcatcctggcccaccgcgccacctataatgagaaccaccgccatatcaggcatgagagagagcgggtgagggtggcgctgtcgcgacttgggttctctgtaacgccctcccatgcaaactttttgctggcgcgggtgcctgcaggacgagacggcgtttggtggcacgcctgcttgaaacggaaaaagatactcgtggccgttcttcccgatgaaggtctggaagattgcattcgcgtcagcatcgggacgaaaccacaaatggatgcgtttcttgcggctgtcgaggacatttcgggagctcagcaatctcgatgatgggaccgtatagcagcttcaggctcggctcttttgcacgtgggaaaagacagtggcgacaggaaagagagcgacaaccggaagactggtctcccacagcgctaactacgccacgcccgtgaggaagctgagttcatagcctggcgcctgcatgtgtctaaaggcgtgctccacaacacaaggtcgctgggacggaaacatctgccggtaggtgcactgaaaaactgttgagcaatagccgagcacgcaaggatgtggcctgtcggcggcttaacgatttggcttccgccaccgttaggcaagggcaggctcaccgtgaatagcgatgttcggccaaataaagcccccaaggtcttatttcgctcgaattgaagtccggggctaccagggttaagtgagacgttaaatgagaaaaatccttccatcaaagctagctttcggcatattcgaccatttagacgaggacggtaacgccatggcacggcaatacgcagaccgcctcacgctagcggaagcatgtgatcgtctcggcttttacgcttaccacctagcggagcaccatttttcgccgcatgggagaagcccatcgccgaatctgttcctatcgagcgtcgcgcagcgcacccgtcaacttcgtcttggcccgcttgtcatgctgcttagcctttctcatccgctgcgtgcgtttgaggagatctgcatgcttgaccatttgagcggcggtagggccgagttgggcatagggcgcggctctcttccgatagagctaggttacttcgggatcgatccggacgcggtggctggacgctatttcgaagccagcgaaatcctgatggaggcgatgaggggcggcaatctttcctaccgcggcgaccactttgaactaaacaatgtccccttgatcctgaggcctcatcaacgcccgcacccaccgacttggatcgccaccaaccgacctgagtctgcacgctgggccgctacaaacggcgcaaatgtcgcatgtgtgggacccgcctcgcttgttcgcaggattactgatgccttccgttccgaggaaggactcagctctgacgcgaactgcaacgcgtcatttctcggactgctccgcatgattgtcgtcgggcactctgcagaacatgcatactcgcttgcggctcctgccttccaacgatggctgaataatttcaaattcctgtacgacctccatgcaattccagttccgccaaatctgcccctgaccttcgatgcagcaatcgaaagtgaattgtgcgtagtgggaacggcggctgttgtgcgacggactctgcttgatcagttggaagaggcgggcgccaactatctcctttgtcaggtcgcgtttggagatttgcctttggatgcttcgctgtataccgcaatgaccattcaatcggaactaatggatcgagttggctgagtgccatggcgcctgacgaagtcaggcgtgtgtaaaagtgacggcttcctgtcgtatcaggcgcaactccaattcggcccaaaaatcaacaatgggctggtcggcgctaagtacatctgactcgaaggtgttttatcgggtagcgtggcttctgggaagaggtaagatggccgagatcgacgcaatattgataacagacgtaaacggaataggaacgaccgcggatgatcaactagcatttgtcagtttgattgctgatcaaggggaaactaccacagtagcattcggtccagaaattggcagcagaatagctgcttcgttcatggccgcatgcggacagctccaacatcaaatcgctacgagaacggggaaggaggaaagaaagttcaagccctttgctgcagccggattcagcgtcagagctggtctggccgccgatggctccaattcgggaatgttatcaatttcaaccgtagcgggcgctgaggttcactttatagcaacggaacgttctcttcgagaactcgaaaaccaattaacgttattgctcgaacaattgcggttacgttcgcgaccgaattaatgcgattgtagcggtaacaaagctcttatgactatcatggctagcaaggcctggcagtaatggatatcacccatttgggtagaattcacgcgggcaattcgaacgacaatcattttgggacgagcggcgctggctggtcgtccatgttgagtgcatattttcccaaacggcgaatatgcccggtgttgggactgagagtggcggcaagcttcggcgtgaagcccgcctgaccacctgccgaaggcatgtcgcttgctaccgtaataccaacttcgctcgggatctgatcgagcgggaagtctccggcgccgcatcccaatcgtgcgctatgcggatctgtcaatcaacagcgcgtcgccctgccgccgccacggcctttgccaccagccgcattgaggctggtggcgtgagccgactgccataattgtcgtgccgggcgcaactccaccgctacgttgcctggatgcgcgacgaacgcgttcgctgtttcgtagtggcggatcggtctcctccttgtccatcgctcgccagcgggtaactgctcatcgtctctcttttcggcacccccgcacccgcaggcgatagtgacagcgccgataggcttgcacctgcgtgcgaccactcttccatctcctcaatagcctccatccaaataagcgattttacatatctgctgagatttcccattagaatagcgtggcgttttgggttgaattcaattgggacaaggatagcagtagacgcggagccttctccacacacggctgccccatcgagtggtatgggctgtcggcaaactgctccggtccgaagccgcactctcccgcgccctgcttgaaaccgccgagcccccggttcgcccgcaggggccgtgtcaaccgtatagtcgctctaaagaggaccacctgtgaaacatatcgttgcaaccttattcgggatactgtttgctacagctgccaatgccgccggcgatagtcatgtactggcgagctttcccgagcttgaacgcgcgctgactaccggcaaaccggtgactgtgacggtcgatttaggcatgtgcactccggcgacttccgatacaccgtcgaccaagacgcgtggaggcgttagcatagacggctataggatcacatctgacggcaccctcgcttttgcagatcagcattttaccatagatcgtgacggtaagccggttatccagtttcttcgttaccggatccggccggacggtggcgccgaattcaccatggtcgtcttcaatgtgcccagttacgagcgaaaaggaacgagccgggtctataagtgctcaattggtcacggattgagcttcttctcttcacagtgatctggcatgttgcagcacgatcgcgcgggttcgggtggcggatcgtcccggatcggcggctgaaggtttccctggggcacccgcccgtgccatttgcagtggtcccgataggtaaaggaacccgcctgccgctatccttgagcttcttcagcggtctgttatgccgtcgctggtctgccaagcatagcggtcatcgaggtcctcttcgatcacgccggccgcgtataactgatcgagcaggtcggcgacagcaagtacgcttattccatccgtcgaggcccgcataaccaactccgaggctgtaaagttgccgcacgcgattagatggccaaccgagatcggagcgtagtcgagcacccggtgttccatgcttcgcgagcggagatggaagcagcggtctcccgctgtgtactccaggtccctgcgaaagcggatcggcaggtcgggggctgggctctcgagcatatgttgatcaatcatgctcttgagcccgtcccggaactcgtcaggcgtcctgaatgaccgttgacccactatgcgatacccgaggggccagcgtccgctacccggtaccggcgtcactagttgcaaacgtctctgcggcatatttacgaggaagccggaaacacaggcgatcgtcgtgtgatttcgctccggaaaggcgattgcctcttgcctcgcactgagtttctccttccgcttgcgcgcccgccccgtgaaagcctttgcggtcggagcgtccttgccctgcatgatgagttcgacccctgtcagttcttcaggcgaaaacgccctgtggatctgattgagatgtgccgtgctgagcacagagaagcgattcatcgtagtgccataaagattgaagaggccgagcacgcgcctggtgagtgcctcatccttgagcggggcggccgtcgttgtttgcggcaatgcgcccgtgatctgatagtagtcgaagagaaagcggtcgtactgcgggttgtccattggctctgtggcccagtagcagaatccagtacgagctgccgggccaaacacctcgctcgcgacaccaaccacgccgcgccaaagctctgcatgctgtttgctatactcgtaatagcctttgaacggagcggccgagaggccgcagaaccagcaaccgacggtgcacccttcgctcagctcgaaagcgatgatggggtgcgtgatcgacggcgctgatccgcccaattcgtcattacaacgccgaatttggcgctcgcgccaggcatgaaagcgagggttggtcattgacatatcgccatggtcgcgcaggaggtcgcgatggcgcaacatgtcgcgcatgtactcgtcccacattatcgacagcggccatggggcagactccggcttgtagcggtaagtaagatgatcatcgcgccagagcggcagtatctccagtgggtcaacttcaatgccatagcgctctgttaccgcgcgaggggcgtcgacgctctccgaaaccgcggtgcggaactttatgtcaccagccagccgttccatgaaacgcttgatgtgcgacaaggtgcgccgttgctccggcgtgcgccggttaaagatctgtcgccaatattcgcctttataaaggtgagcccttgaagccgtttcttgtaggccagatcgcatgtctcgttcccgatgatatttgctgtcatgctctcttggcaccgatcgtccaagccaatgcgctccggtaaaaaatcagcttgaaacatgaacaacaattacaacaagttgaacgaccgcggcgacggcggcgcctttttcagcaatatgcaacggccgcgtgagcccatccgtaacgggactatccaaagcactagattgtactaagcgcggcaaggccggaacgcgcgagccacgcttgctgttcgccatcgcttcgagcttcttgccagtagacttccgtcggctgtccaatcggatgtagttttgaacttcgtcaagcgtgatgttgtagccgagactctttccggccgctacgatcggtgcaagacccgtggcacttggcttgaggtttgcaggcagcctgcctttgtctaaatcgttgacgaatcgctctacgtcagctcgcggcatagctaattcctttgctcatagttgccaattgcaggcgtggatgatgccgtgaacgagcaagcgccgtgccaacctaaaaatgtcgtcattttgtgcattttcagagtgcatgcattgtcaacttaccgacctttagtcccgaaccggccaattggccgctccgaaatgtagacatccgcaaaattcttcactaaggcaggctctcttttttgccagctcagttgcggattccgccagtcggttcattcagtgaaacatcgggatacgctcaaaagcgtgacgacggcgtagcggcgtcagagagaagcgtcgacgaatcgtgcggagtgtgggggtcacaaacggccggcatagcaggtcgacgacccccacggcggtggggagatcagagctgtatgcgtatcatccggacatgacccaggctcatgcaaccctgaccgcgaccagcgctgaagcgggccgacggcatcgggttggcactttaggcaccgacgcattagcaatggacgcgcatctgcgccgactgggtatcggcgatgtgcattatgatctgtctaggtttcgatcgccttggtcttccgacccttccatgcaccacgtgccaacgagttttattacagcctgctaaactaaccgcttcattccaacgcgtccggagccgcgactactttgtcggactgatgacatcgctgtgtcgcaaccccgccgcagtcactgatttcggatggctgcaagagttcttccaatggtacgaagacttggattggcgcagcagctttagtcggatcgcgatcctcaagcaccttgaaaacacgatgtttgagtggcgacgaagttgcaaagtccctgtaagcgcgctcgagtgcggcgcgcgcacgggtggcggccgtgcctgtggggagatcggaaaagtcctccgcgaccagatactgacccatgcgcttcattatgtggagccgtgatgtgtttagcacctttgggtcataggtgacgccgagggcatcgaagaactcctcggcggccgacaaatccttcagccaggtgagaatgtcagtgccatcaggggcaaaggtcgcatcatcataagacattgcattctcctactggccgcggaatagctgctttcgttccaacacatggtcccggccctgcaccctatgatgaccctgggaagagctgtgatcgagacgccatcagtgacggctattcggacatgcccaagcgctcaaacaatcgtatgtgccggcagagcgtctacccggcaaatactggacgagattcacgcagttttttcacaactgcgggtatcacccgcaacacccgatctatatcctcttcacagttatagcctgacaacgagaagcggactgctccgaccgcctgcctgtggggagtacccatggcttttagcacatggctcgtcgataaagaacgagaggtacaggcggatccggaggagcaggcgatgccatggcgattgagcagaaactgcatggcttcaccaccgacgccttcaaaggcaatgctcgttgtgttgggcaaccgcgtcaccggatcacccattacgaagacttgggggacacgctcgagaagtcctttctccaatcgatcgcggaatgatcttattatcgcattgtccttgtccatacaatccaacgcgagttctgccgccttgcccagacctactatcccgggcgtgttctccgtgcccgcgcgccggtcgcgctcctggtggccacccttgatgagtgcgtgaaagggtaccccgcgctttatgtagagtgccccgacgcccttcgggccatggaacttgtgcgcggaaagcgacagcatgtcgatcgccgttgatttcaagtcaatcggtagcttgccgattgcttgcaccgcatcggtgtggaaaattgcgccgacttttttggccatctcagctagctttaccacaggaaagatcgttcccgtctcgttgttggcccacatgatcgaaacgattgctacacggtgtgtaagggcgtcctgataagcgtcaaggtcaagtcggccctggtgatccactgggaccttgtgcaccttggtgccgcgtgtcttctccagatgggtgcagagcgtcagcaccgcaggatgctcgaccgccgaagttacgatctcagtgcgctcaggcatagcctcgagccccgaaaggatcgccgcattgttgctttcggtcccgcccgaggtaaaggtgatctctgggtcgaactttgcaccgatcagtgcttgcaactgcctgcgcgctacgttaatcgctgccccggcagtagcaccagcgtcatgcatcgaggaagcgttgccaaacacatctgcaaagaatggcagcatcgcctggagaacttccgcatcgacgcgcgtcgttgcgttgttgtcgagatagataggcctcaagataattctccagctaccgaaacgacgaaaggtttacaaatggcgatcgtggcattgtagaagtgctttttgatccagcattactgttctcccgtgcgtggcgatcagccgaacgatttgccccaggctcacctctcccgcgcgttgaaacgttgaagactaacccgggcgaatccacccttgggatgacgtcccggccaggccggccacatggggttgggggtccgagtcaacaaatatgttgatcccatccttctcgataacagtgtcgccctcgcgcgactcagtctctaatgcaaaatggtatatgcacagccgtccgcttgaaccgtcatatgcataagccatcggtcggttcagaatcgcgggaaggagggagcttcactgcactaacggctcttccgttaagacctatcatggatcgtttctcctggttcgaaaaggcctttgcaaatcggtcaagcacaaactatgccaacgaaaaaaacggttttgaaacaacaccgaaactcaaacatcggtgtgacatttgtccgacaatgtcggaaatcggacattgtcgaattagcccacaccaaagagcgcctctgtgccgcaaacaagatgcaatgtgatgacttcggcggcgcagctcttcgaaagcttgatggcagacggaggatgccagccatagcggcgattgctggcacttgcctcactctacaatggcggcccccgttcggaggcagcgccattcggcagcgagatgctgcagtgttgggtccccaacgaacggtgcaccgcggcgaccgagcgacactgaatgacgctcagcgcccggggctggcaaaggacgtcgaaagcaggctatcctttaaattcactggcggcgcagatttggtccagaagttgcgcatttcggatgaggcgacggtcgggcgtgaactggtgacgcccggcttcgccagagctcccgcaaatgcaactacagcgaacgcccgcgggcaaatgacaggcagcgctcttcgaccaccacacctcggggaagcccagtccgtatttcggcagctctttcggccgggccagcgcgtcccaataggcgatttgggcggccagcttgtaatagagcggaatgacgtaattatgggcgagcaggacgcgatcgagtgccttcgttgcggcaaccagcgtttcgcgatcctttgcgaagatcacgcgctcaatcaaggcgtcgacgccagggtcggagatgccggcataattcctggagccctggcgtgtggcggctgccgatccccagtagtccgcctgttcgtttccggggctcaaggactgaccccaaacttcccaggtcacatcgtagtcgaaggcacgcttgcgattggtatattgcgatgggtccaccgtgcgcacgcgcgcttcgataccgatccgcttaaggttctgcgcatagggcaaggcgacgcgctcgaatgacgggctgctcaacatgatctcgaaggagaacggcttgcccgtctcagtattcaccatccggttaccgttgagctcgaaccccgccttgttcaggagctcgatcgccttgcgcaggttttcgcgcgccttttgcggcgtgccgccgaccgggttgctataaggggtggtgaacacttcgggcggcacgaggtccttgacctcgttgaggttcttcagttccttgccttccggcagaccggaggaggcgagttctgtggcgaagaagaagctgttcacgcgctgatactgattgtagaagatggtccggttcagttcttcgaagtcgagcgcatagttcaatgcctggcgcaccctctcgtcgtcgaagggcttgcggcgcatgttcggcaccatcgcctgcatcacggccgttgcccggaaggggttgggaatttcctcgcgtttaacgcggccatccttcaccgccggaaaatcgaaggccgtagcccagcgcatcgcctggttctcccgccaataatcggtgttgccggagcggaaggcctcgaactcgacgtcgcgatcgccaaaaaaggaataggtgatcgaatcgaaattgttctgcccgacattgacgttgagcgcgacgccccagtaatcgggccggcgctcataacgaatggtcccgccgggggcgaacgaagcgatccggtagggacctgaccccatcaccggttcaagcgtcgttcgcgaaatgtcgcgcggcttgccgtccggtccagtgccctcccaccagtgcttcggcacaatccggatctgcccgaggatatgaggaagttcgtgattgtttttgtcgtcgaagtgaaaggtgacgtcccgatcccctgtcttttccgccttcacgacatgccgatagtagctctgatagagcgggttcagttccttcgccttgtcgaagctgaagacgacgtcttccggcgtcaccggcttgccgtcggcccatttcgcttcctgcctcagccggaacgtggccgaggagatgtcgtcggggaaggaaacgccttcggccagaagcccgtaggccgtcgaaatctcgtcctctgacggtttcatgagcgtgtcgaagacgaaatccaggccgacggccgtttcgcccttcaccagcaggggattgaacgtgtcgaaggtgcctgtctgtgaaagcctgagatctccgcccttaggtgcctcgggattcacatagtcgaactttttgaagccgggcggatatttgagatcatcgacgagcgacagtccgtagtgccagaccggctgctcttgagcctccgcagccggcaccagtagtaaggacatggccatgaacgcggtcgcaaacttcagtcttccaatgacgccgatgtccagcatctcgtcctttctccttgtttttatccattcgccgccacggtgtttgtggggcggctccaagtcgttgcaggatcggcatgtcagtggccgatcgtccctagatatgggcaattcacactcctcaaaaattgattttctaaattctgttcatagcgtctatggatatgcggagctttgtgcctggtagggtcgcggcctgtgtcgctgtacccgttgtcactttttctggcggcggcgatgacgtggatgtcgaccagtgtcgcaaagtcttccttcgtcgctgacaagcgtcgacgggataaccagtatcaggaaaccggtcatcaactgttcttgcgccttttccgcacagccggcgaccgcctcggcaatgagcgaggccggatcgataagcactgcccgcacccgactgcatcacattggtgaccgcgaggtggacggcaagtaccaaagtcgagaaggtcaggtatcaaactcgccttgccggcgatgggaccaaccttggcgagaccggttatgcctgcgatctccgtcgcgaccttcaggaagatcaccggtgcaatgatcattccaagctttccgatgtccggatagaaatatccaaacaggatgcccgcgatcgctgccagaacctgggcatagagatggcgatataagggtggcttggcgcgggtctccgcggaatgctcaatggtcatcaggagatcctccatatggggcgcgcccggtcgcctgccaagccgattctccgaaaaccgacagcggcgactgtcatgtgaagctgatgagcaatgaccgtgccagttgccgttaaaccgcagatcctgacgcccgaggtgcttactgttctcgacccgaccagccccgccatcccggtaaccggccacggcgacatactgatggtagtgcaggcgattaggacgacgcctctgacattatcgccaagctcttcgccgccgacgtgatccacgaatttgagtgcgcgaacaccatcggtctggcacgacgggactgccacctcaccgccttctgtccataattctcacctttgtctcaaggcaaaccttggccggcaagaaatgttatttgcctccatcaaatgaccgccgagacatcttaatcggcctccagccaaagtccgcagccgcagcatcgattatcgataaagacccgggtggaggatagcgagatgacagatttttggcgccaccgacagaactggcacaaatcttgaacctgctcattgcgaggcggcggagctgctcattgcggcaacaatcctatgcctcgactgcgccacgtatgaagatttcacaatactattcaattgagttcttgcgacaaatgggcgttgacgatgtgcaagatggtcgccagagccgccgtaacgagaggaaagcgaaatgtccaggaccgcagaaaagcccttcgaaactgtcgaaaactcgatcgtcggtcaatccacggcaatcaataggggcgagcaattgacgcatgctattgagttacaggagctggccggatccgtcttcaagtcaacaatgatggtgggatttgaactgtcgctgaacactttcgctgcagtccaagccaacaccttcgctaatttgcaccatcttagcgagtttctcggggcaaaatcgccgtcccaagttttcgacctacagtgttccttcctgcgcaagcgtatagacatgggtgtcgagcaggtcaaagaatcccaggcgctcagcaccaaggctttgattgatatgtcgaagccaatcaaggaattctttgaaaaggctatagcagacctcaagacggcctgatcgtcagcgatccccgccgtggcaggccgtgacccgccacggctttgcgctcagtagcctggagtaccattcgatgatttccgccgatttgtcggattgatgacatcggcttgtgttataggtggggggaaatcctggacgctatctacggcttctttcgccctcctgcaggaaggcggcacctccccattgcgcattcagggatcacatcggccccaaggtttctgctccggtctcttgtgcgcaccgcagcgcaggtccttgcgcacaagtagtcacgttgatcttcattcagctccctcgacgtctcgaagacccaaccgcgcaacatacaccggatcacgaatggacgtcgcgtaggccgcggctcacgaaaggcagggatgttgaactgggacgacttctggcctcgcctgacgcgtcctaatagggaccacaccgtcagcgccggccgaatgacacgtggcaccgcgacctgcacggcgcctgatctgcaaacgaagcgactatcaagttcgcaacatctatcctggccgcccagcgcggctgtcatgaatcgtgggacactctgcaagccggcttcagcacagcctggttcgccgagcaccacttcgacaactacagcggtccgtcgcctttgtcgatcgtgacccactgcgccggtttgactacgaccattggcgcgtcggacgctttcgacaattgtttgtgaaattgtcggctccgcgacacaggcttgcttctgggtcggctacttctcctaatctaagtagctgtaaaagaaggtaaaccagcttctgctgggctcaccctcctcgacttggcacggcttttgaagccttccttgtgcaggcggcttgaagctgccgctgtattcgtgttgcgggcaaccgcgatggtttcgaacaacgaaggaaagcaacatggcaggtctgcgtcaaatcgcgttttacggcaagggcggtatcggcaagtcgaccacctcgcagaacacgctcgccgcccttgtcgacctcgggcagaagatcctcatcgtcggctgcgatcccaaggccgactccacccggctcatcctcaacgcgaaggcgcaggacacggtcctgcatctggcggcaaaggagggatcggtggaagacctcgaggtcgaggacgtgctcaaggtcggctacaagggcatcaaatgcgtcgagtccggcggccccgaaccgggtgtcggctgcgccggccgcggcgtcatcacctcgatcaacttcctggaggaaaatggcgcctatgacgatgtcgactacgtctcctacgacgtgctgggcgacgtggtgtgcggcggcttcgcgatgccgatccgcgagaacaaggcgcaggaaatctacatcgtcatgtccggcgagatgatggcgctctatgccgccaacaacatcgccaaggggatcctcaaatacgcccattcgggcggcgtgcggctcggcgggctgatttgcaacgagcgccagacggaccgcgagctcgatctcgccgaggcgctggcggccaagctcaattccaggctcatccacttcgtgccgcgcgacaacatcgtccagcacgccgagctcaggaagatgacggtgatccagtatgccccggagtcgcaacaggcggcggagtatcgcgcgctggccgacaagatccatgccaattccggccagggcaccgtcccgaccccgatcaccatggaggagctggaggacatgctgctcgatttcggcgtcatgaagaccgacgagcagatgcttgccgaacttcaggccaaggaagcggcggcagcggcccagtgaccgccgccgcagacgctgcccgggacggtgatccggtgcgacattccaccaatggtgcctcttcttggaggacacgcaaaaaagggggcaggcccaatgagcctcgattacgagaatgacagtgcgctccatcaggagctgatcacgcaagtgctgtcgcagtacccacacaaggcggccaagcgtcgccaaaagcacctcagtgtcgcatcggaccgcgaggcggtcggggaggagggcgagaccctctccgaatgcgacgtgaagtcgaacatcaagtcgatccccggggtgatgacgatccgcggctgcgcctatgcgggctcgaagggcgtggtctggggcccggtcaaggatatggtccacatctcgcacggcccggttggctgcggtcaatattcctggtcgcagcgccgcaactattatgtcggcaccaccggcgtcgacaccttcgtgacgatgcagttcacctccgactttcaggagaaggacatcgtctttggtggcgacaagaagctggaacaggtcatcgacgagatcgaggagctgtttcccctcaacaacggcatcaccatccagtccgaatgtccgatcggcctgattggcgacgacatcgaagcggtgtcgcgcaagaaggccgccgaacacgaaacgacgatcgtgccggtgcgctgcgaaggcttccgcggcgtctcgcagtcgctcggccatcacatcgccaacgacgccatccgcgactgggtgttcgacaaggcggacggcaagacggacgtcgagttcgaaaccggtccctacgatgtcaacgtcatcggcgattacaacatcggcggcgacgcctgggcgtcgcgcatcctgctcgaggagatcgggctgcgcgtcgtcggcaactggtcgggcgacgccacgctcgcggaagtggagcgggcccccagggccaagctcaacctcatccactgctaccggtcgatgaactacatctgccggcacatggaggaaagatacgccatcccctggatggaatacaacttcttcggcccctcccagatcgaagcctctctgcgcaagatagccaggcatttcggcccgacgatcgaagaacgggccgagagggtcatcgccaagtaccggccgctggtcgacgccgtgatcgacaagtactggccgcgcctccagggcaagcgagtgatgctctatgtcggtggtttgcgcccgcgccacgtcatcaccgcctatgaggacctcggcatgcagatcgtcggcaccggctacgaattcgcccacaacgacgactaccagcgcaccggccactacgtgaagacgggcacgctgatctatgacgacgcgaccagttacgaactggacacgttcatcgagcggatccgccccgatctggtcggctccggcatcaaggagaagtatccggtgcagaagatgggcatcccgtttcgccagatgcactcctgggattattccggcccctatcacggctatgacggcttcgccatcttcgcccgcgacatggatctcgccatcaacaatccggtctgggatctctacgacgcgccctggaagaaaatgaccgtgccgacggccgcagttgcagccgaatgatcggccggtcttgcgcggcacgaggaccgcggcaagaccggaaacctctcgaacatccctgggcctaagaggccagatcaagaaggtcaaacaccatgccgcaatcggctgagaagatactcgaccatgcgccgctgtttcgcgagccggaataccggcagatgctcgcggagaagaagctgaacttcgaatgtccgcaccccgaacggctcgtcacggaccagcgcgaatacagcaagggctgggaatatcgcgagaaaaacctcgcccgcgaggcgctcgtcgtcaaccccgccaaggcctgtcaaccgttgggggcggtgttcgcagccgccggcttcgagcggacgatgtcgttcgtccatggcagtcagggctgcgtggcctattatcgctcgcacttgtcgcgccacttcaaggagccggcttcggccgtttcgtcctcgatgaccgaggatgcggcggtgttcggcggcctgaagaacatggtcgacgggctcgccaatacctacgcgctctacgatccgaagatgattgccgtctccaccacctgtatggccgaggtcatcggcgacgacctgcatggcttcattgagaacgccaagagcgaaggcgcagtcccgcccgaattcgacgtgccgttcgctcacacgcccgccttcgtcggcagccatgtcgacggctatgacagcatggtcaagggcatcctggagcacttctggaagggccaggcgcgcacccaagcggccggcacgatcaacatcatcccgggcttcgacggcttttgcgtcggcaacaaccgcgagcttcagcgcctgctcaccctgatgggcgtgtcctacaccttcatccaggatgcctccgaccagttcgatacgccgtccgacggcgaataccgcatgtatgacgggggcacgacgatcaaggcgctgcgggcggcactcaatgccgaggcgacgctgtcgctgcagcactacaacagccgcaagacgctcgaatattgccgggaggtcggtcaggccaccgccgccttccattacccgctcgggatcaacgccaccgacgcgttcctgatgaaggtgtcggcgatttccggccgggaaatccccgagacgatacgcctggaacgcggccggctggtcgacgccatggccgacagccaatcctggctgcatggcaagacatacgcgatctacggcgatccggacttcgtctacgccatggcccgcttcgtcatggagaccggcggcgagccgcggcattgcctcgccaccaacggcacggcggcctggcaggccgagatgaccgagctgctcgcctcttctcccttcggcaagcaggcaaaggtctggccgggaaaggatctctgggccctgcgctcgctgctcttcaccgagccggtcgacctgctgatcggcaattcctacggcaagtatctcgagcgcgataccggcacgccgctgatccggctgatgttcccgatcttcgaccgccaccaccaccaccgctttccgctcatgggctaccagggcggcctgcgcctgctgacgacgatcctcgacacgatcttcgaccgcctcgatcgcgaaacgatgcagacggcggtgaccgattattcctatgacctgacccgctaaaagcggcggtcggcaaaacgccggcccgggaaccgcaccatgggatcgcgagcgttgaaatgggctgatcgtttagctcatgcgctatcggaactgcgctcggaagtgcattcggacagccaccttatcattctaaaggggcatagcggcatatgaattttgcatggagagagacagacggttggtagtattgccggccactcacgggatcgcctcgattaaagagggcccgtgcttcaggacgaggactaaatgatgacagcgttatctgatccccggtttactcgagctgtcagtgacgatggatcgttggccacccctttcatgaaatgcctcgcgcggttggtccgcgctcatgattcctacggattatggaaggataaatgtgacgccgagttgctggccaacttcacagttacggaggagcagcggcgagctatccccgtcatcggcgaccccgagccagacgtgctgttgaggctcgaccttttttacgccgccgtcggcgtcgttatcgaggagcgctcggggcttttgatctcgcgaacgctggagatcagcgatgagggcatcggccgagtgctcttcacaaccaggcggctggtggtgctgtcgaagaccctacgtgacgttcaccggttcggcttcaatacacttggcaaatgcgccaagactggcacgaagttggtcaaggatgcgatcaaaagcatcgaaacttatccggacgtggcgcgggcataatgtgcctgcaaggaataagaccatgacagatcttgaagaactcaagcagagggttcaaaaactgcagtcacgcgctgcgactgcgaagacgcaattgcatgaccttgccgagtgccttccgaactattggaccgaaatagtggccgtcgccgaaaaaacattcgacgcttttgctcagttggacgctgccaaaagagaactcgccgcgtcggagaattcacgatgaaaagctcgttcgtgacccgccgcttcagctggtgccggaatatctattatgcatcggctgcggctgctgactcggggcgcgaggtatgcaccttcacgggatcaatgacgcaggtgaaattctcggtgttttgcgacgccgaggacgatcattccagcaaccagatcatgtgatcatgtccggcgacagcgccggccgctgtatcggctgcggagccggagtgcgtgtttacccaaactgccagaatcatgttgcggccgacgacattgccgcatgatcccacaaacaaaccaggaaaacggcgttgtcttttggtatctttcatcgaattctatggctgttcctgtgcgccaacactcttatagtctacctcgtaacggggtccatcagtgacgcagtcgtcacgactatggttggttcgctgcttctgcagctaacttatttcgcaaacgtactctttctgctctggcgggctcactgcgcccggagagctcgtcaaacgaccgggcaattccatggagaggaacagccgggggaccctcgtatagcgggcactcacgggcgcacggatggggatccgtgcttcgaggacgaggactctcgataggccccttgctaaccgcttcatgaaatctctctcgtgcggctaaatccccgctcagctttgctttcggtgtgcaaggacaagtgcccgcgctggatttctggccgacttcactgtcaccgaggaccagcgccgtgcgaccgcgtcagcccttgaagcgcggaacaagagagtgcgtaagctgcagccgttctggaaagcgaacatggaatttgcgtaatgtcgccaaggaccttccaatcaatggagctgatcatggtagtcgccgagaatacgttggcgcctttgctcaggttagcgctgccggattgctgcccgacggcacaatctggggaatgctaccgcttcagatggtcctacattgaatcttactgtgggttctccctacagatgcgccaccttttaacataatcttgacgatagtgaaaagtgatgctggatctgacgaatgcgaagcgcataggaatcatcggcggcggcattgtcggttggcttgcagcgatagcgcttcgccgtgttttcgacgttgatgtcgatgtaacggtcatagaggctccgacggtgtttccgcttggcccaggggaggggggctcgctcaacctgattgacacgttgtgtcgcaatgagctcgacctggacgttttcattggtgaagccggcgccacccacaagcttggtgtgctctatgaaaattggaggggtggaggaatcccggatcgctactaccgcatgttcggcggatcgggcataccggaaatcgaatgtcgcgtcggcggtttcttccctctgctgtcggcgagaattgccgcaggtgagaaccttcacacgtgcatccctggctttgagttaatcacaaagaaggcatcgcaagtggaaatcgacgagttgctggcaaccggtgagtctggactctacccttcgtttcacttcaatcacgccggcttcgagcgatacctaaggcgcgtcgggctggcacgtgggatcacttctcgtagggctgtggtacacgggatgagactcgacgaccgagggcatgtaaacgctttccagctcggaggcgaagaacttgaagtcgacttcgccgtcgatgcgtccggatttgccagattgggtctcggcaaagtctttaatacgcgctggtgttcgttcgcaaatgtgctgcctactgatcgtgcgatcatctttgagcttgagccgcggggatcatcccccgttacccgtgccaccgccatgaaagccggatggatgtgggaagccccattgaatcgctcgatcagtgccggttatgcattcagcagcagatatgcggacgctgcgatggcaatcgccgaggttgagaatcactatggattccgtgtggaggcgaaacacgagctttcgctggatcaaggttacttttcgaccgcatgggttaacaatttcgtggctttgggaacagcgtcgggttttgttgagcccctggaggctgcacttgccgcccacaccttcgaagcgttaaggaatttggagcgcattctcgccaacggaagcggcattgtgcccgctcgggccatcgaaggctataacagcgcaaacgcacggtgctggacgggtgttcgggacttcctgaggctgcactacgattccaagcgaattgacacaccgttttggcgagatcttgccgcagccgagttgccggaaggatatgccaacctgagggcttgcttccaaaaacggacaccacgctttatcgatatccaaccgtatgtcggaagcggatggcagagcctcttccacgaaattgattggatttcagtggcggtccctctaggagtagtgccgcaggcggccgcatgcgccgaactacgcaggctctctacggaaagtcgaagtgaggtccaggcctatgttgatcggctgaagggaacaatagccaagatcagcagcacgaggggatacatgcactaatcgtcacacaaaagccactccgcggccgaagccgtgtaccagggtcttgcttcatgatcatggcggagcggcacattgatcgtgagcagggtgtctcaaagccggtcaaatccgcggctgcgaacgactagggtcgatattccactgaatcacgcggagctgtcatgtgcaacgcttcctgtagtagtacctgccgcatccagatgctcgcctgatccctgttgtgtaggctaggccactggacagcttgggcgaatggtggaagtgccagtggaagttcggcgacccgcagcggcgttgtttttgcgaaatgttccaccagccgcaacggcatggtcgctatgcgatcggttcccgacagcaaaggcgggattagactaaatcccggcacgacgacttcgatacgcctcttgagaccgtgctcaagcaacaaccaattctcgatggagggctttagcgtacgtccgaacttagccgcaatatgacccatcgatccgtagttttcgaaagaaagctgccgttttaactgcttgttagtggggcaacctacgcaaaccagcgtgtcgtcgagcagtttcgcctttggatgatcgctcgacgcgaacaattccggaaggatcacgaaatcgacgtcaccgtaccggagaagttcatcgggatcctcagtgagaggcagcaactcgaagccgatgccaggcgcctctcgcgccagccgcttcacgactctttcaaaaaacaccagcatcatgacgtcggaaagcctgatcctgaagcgtcgctccgactgaactgggttaaacatatcccaagaaatgatggagaactggatgtgcagcagagcatcgcggactgcgggggcgagcgctatcgcacgcggagttgggataagttcgcgacctcgcatcgtgaacaagtcgtcgccgaaataggtgcgtaggcgggcgatggcggcgctcatggccggctgactgaggttgatactgcgagcagctgcggtaacgcttcgctttgtcatcagagcatcgagcgctacgagcagattaagatcaagtcccttaaaacgcattatataattcaaccaaagcgtttctgccctcatagaacaggtagttttcagtgatgttacagagtgagcgccgttgccttgttcccgctgctcagaagaacatgagggagtggagcgcactccgtcccgagtaccgtaaagagcgggactatcccaccacattcgacacaccaaatgagtggtgcgttgcgacaaaacttcggcttgcagaggcctttccagcgtgctgatgagaatggagtgcaacccggaccccggcactttcgggagctgacgtcggtgaccagctgttccccgataacagagtgaccctcggttagcctgttcttcaatgcgatattggttttgcgggcggtctcaatttcggacgtggtttccaatctgctgggggcatcagtggctccgggcagtccgcagttttcgagccgatctggcacgcggctgtggaactcttcgcccatcgcctcaatgaaccattcctgcgtgccagcaaaggccttgagttcgaccctctttagcgacgccgacctcctcaacccgatcgacgcgtcgggttaatgtctcgacagcaggatcaggagaggacaccggttcgatccactgcgacccgcccaggatcacattgtcttgtgcgggcgtgccgcctggctggaactttcctgagtgcatcaatggcatccttctgataatcagacgaagcgatggcggatactagtgccgcatcgacccggtcgcgctatgcaaagttcatatcccgccatgcgcttgagatatggttctaaactctttgcaggatcagtgctgccagccgaacagtcctgacccacagatggagtaaaacgaccgacctctcactttcgcagaggacgaatagctcctgattgaaccttcaggagcttgacatcgcggactgcagacggcaggcgacacacccgcgaagcctttttgtatgccagcttgctcctagtttcttagttcgccgcgaatcgcctcacttcaaccgcgtcggaaccaaacgttgatccgatgtgatgagccattaatgccagacgtgccccactccacattggtttccgaagagcaccattaaatctgcgcccaatatctactgctgctgttaatcagcctggctgacagaaagctgacgcggaggggttagggcgttgttcatgtacatccacaaaacttcctccagcgaatttaggattgggtaatagtcattcgcgctagtgtgttctggatgtccatcagtgttcgtctcgcgatccttgatcgaaccggagctcgccgttcagcctgagtggttcatgtaacggcaaagcagtgtgcgacgatagctcgacccccgaagtaaatgtagcgaaatgcatccatgatgcagatgccttcgatccgaagaatcgatttgctcaatcagtttctcttaaggcaaaggctgatctaatgaaggtgtaagggatatcaatgcgcagagaaatctcaggtgtatttttggcatcatgggctcgccgaccggtgtatttctgctcgtcaacagaccttcgcccccgctatcacaggtgtttgggttacatgctccttcgattagccctcgcacggagcgggtacgaaaactgcgatcagtcgcgcggtactgctgtcaccccggtcatagtccgcggtgacgtgctcaattggctgtcctgccttgataggagaatgaaatgcgaacgttgctcgtggatacggatcttacccgcgcggtccgaggcgcgctcggtgacggcggctttgccgttgatgtagttggcacgctggaacaggcgtcgagcgcatttttttcagcgagctatgaaattctcctgctggagttggtactgccagatggcgatggactggattggctgaggcagctaaggagcgacgggtattcagttcctgccgtcattatgagcaggctcgacgatctcgagaaacgaatttcggtattcaatagtggcgcggacgattttctccgtaaacccgtctctacggatgagctcatcgccagaatgcgggcccttctgcgccgatcgacacagatcacttgccccatcattgaatttggcaacctccacttcgatccgatcggccgacaggtgtcggttgacggtcatccgctaatgatcgcacgtcgcgaactatgcattctagagcatctgcttaaccgcgcaggtcgcatcgtgccgcgtgcgcggttggaagatcaactctattcgttcaacgacgaagtttcaggcaacgcgcttgaagccggaatctaccgcttacgcgggtatctcagtaggtcaggtgccacgttgcggatcaggaccgtgcgcggcattggctacactcttgaattgactgacgcgtcatcagcatagtcgaatttgaaggaaggactgccttgaaagccactccaactggtcatgctagcgccgatcgatggccgacccccatcgtcggttcaaggccaactgttccatactggagcaatcttctctacgcgctcgttctgttgtctcctatgtccgccgctgccgaaaacaacggggatgaagcggtgcctcgtgccgctcccaacagcatcaacgccacgctgaacctttcctcttcgctgggcaagacagttcatttgcccgcgccagccgcgaccatctttgtggccgacccaacaattgctgattatcaggcaccctccaatagaacgatcttcgtctttggcaagaaatttggtcggaccagcctattcgctctggacgaaaacggcgaggctctcgccgagttgcatgttgtagtaacgcagccgatcgcagatttgcgtgccatgttgcgagaccaggtcggcgactacccgatccacgtcagctatacgccacgcggcgcaatcctcagcggtacagcgcccaatgccgaagtcgttgacattgcaaaaagagttactgagcaatttctcggtgacggtgcgccgatcgtcaacaatatcaaggtcgccggctctttgcaggttaatctcagtgtgcgcgtagcggaagtctcccgcagcggtctgaaagcactcggcatcaacttgtccgcgttcggtcaattcggcaatttcaaggtgggtgtgttaaacagaggtgctggacttggttcggcaactggtagcggcggtacagcagaaatcggattcgacaatgatgctgtcagcgtcggcgcggttctcgacgcgcttgctaaggagcacatagcttccgtcttggccgagccgaacctcactgctatgtcgggtgaaactgccagcttcctcgccggcggcgaatttcccattcctgtcctgcaggaaaatgggcaaacctcggtggaatttcgccgcttcggcgtcagtcttgaattcgtaccaactgttctcgacaacaacctaatcaacattcacgtaaagccggaagtcagtgaactatcgttacaaggtgccgttcaagtcaacgggatcgccgtgccggcagtttccacgcggcgtgccgatacagtcgtcgagctcgcgagcgggcagagcttcgtgattggcggtctcatcaggcgtaacgtcaacaatgatatcagtgcatttccctggcttggccgaataccgatccttggcgctctgtttcgttcgtcctcgtttcaaaaggaggagtcggaattagttattttggttacgccttacatcgtcaggccaggctccaaccccaaccaaatgagcgcacccacggaccggatggctccggctttgggcactccgccgcgagcccgcgctgctatcagcaccgacgcgccaagcgtcaagggcgatctcggcttcatcatcgaatagtggtgccgaatgacgttgcggatcatagctcacctgctcgctttgacagcaagcttagcaggctgcacaagcactgcaccgatctatgtcgagcaaccgacaccgatttttgtccgacaggagtccaccgtcttgaagttggagagctttcacgcttccgaacagcagcgtcttcttgccttcctatggaaggccagtcgcggccggagggatgcccttcacctcgttatcagcgggtcgtcccggctcagcgcagaggcggtccatcaagccagacagatgggcatcggcgcttccaacatccatttgcttgaccaaaatgaccgcgggcacctgcggatagaggccgttgtctatcatgccctccctccaatctgccggtcgctttccagccagttacttaatgacgaattcttcgaccagccgatcggctgttcgacgagccataatctggcagtaatgatcaacgatccgcgcgatttgctcggcaatagatttgtcaagcccagcgatggtgatcgggcggccataccagttaccacctacaggacctcgacgggtaaaggtggcttatgaggcatgaacgcgactgttctcgatgatcgcttcatccgggttgggtgtcccctcaactcactcaacccgcatgagcggcgcggcgctcccgactttgtttaccgcggttgcagtcactgagaatgtggcgagatcggatgggatcacttgccggtgtgtcagtcggcacggaaattgttgagcccctatcggcgcttgtgcacaagcaagatcgatcgacgcccagacagccagttagagggtcggtacgtcagtctcgccgatacgaagctgagtcgacgtgtatataggtctgactgcgtcaatatcttggacgcttgtaacgtttggcgccggtcagacgggggtgctaagaattcctgcccctttcagggcatacgctgtgcgcttcgatcgtgaacgcctactctgcaggaaagcccgcacccgagtccgcagatcaaatgtcaaaatccaccgatggcctgatgcgaatgactccctcgcctcggaattcggcaacgtgccgcatgcccatcatcaaaaacgttgttgtcgggacctctgcggttggcattagccccgtggccctcagcatgctcatctggtcttctgaggccatgtgaggagctaagaaccagtggtcccacgcacgaacgccgctatccataacgaaatcagaaagttcagccggctcggcccctgcggacgaggacggccaagcgtgcgatggccgggcttgcgacggtccagagtgtgatggtcccacctgccacggtccagcttgcggccccgcggcatccacgcgctgccatatcaaatcctgatcgtattcgggcacctgcagcgcgcgagcatgcggttgctgctcgctaggctggggagaccttcccctctcagcggtcagtggcgcgggagaagctgtagcccgcgtatgcaggtcctgctgccaatcaagcaatgacggattcgcccaatccaaatactgcgagtagggatgcttggtttctaagtcggtggcatgcggcggtgggcttgggttcagtggggtggcggacggggatagcccggcttgcgacggtccagatcgtgatggccccacttgccatgatccttctcgcggtcccgcggcttccaggtgctgatcctggtcgtgttcgggcgcgccctgtagcacccgagcatgcggtcgctgctcgctaggatggggagacctttccctagtcctggtatacaggtcatgctgccattcacaaggtgatggataaggatatgccgaatccaaatactgcgagtagggatgcctggtgtccaaatatggggaatcggcttcaacctgcggcaatagtgagtcagcggcatgtggagggctatattgaaatccgctcagctgatgcgcaaatgcactcgcgttggcgggtggtggagagtccggctgtgggcttgcgtttagtgggctggttgaattgatatccatcctgtttctcctttgaaatatggaggccccaagcctttccgatgcggaggcggcatcaccatctaatccgccctgcaattgttaagagacatacctttcgagaagctgacaatcagatggaccgaatgaagaccggacttatgtccgctcgaacgtcgcgtcgctggcgaaggccgttgacagatccaggatgatagagacaacagctgtcaacatggcacgcgccaagagacaatgtttcaacacgatatttcttctttagcgacgtgattggcgcgccttcagccacaggccgagcgccacgagaaaagacaggccgtagaggcccgtgacgagcgggaaagctgccttgagcccaaaccgttgcgtggcggcgactcctgcaatgatcccgacgaccgaagcgccctgctggcaggtctgcgcaagccccaggaccgatccctgcctttcgcttcgcgtcgcggccgagacgagcgacaggagaaccggtgtcgttcctccaagcagcgcgccccaggtaaaatagagcgctgcgaacagccctatcgcacgggtcgagccagcgagcccggtggcgacgaagcatccgccagcgatcagcacgttacatccgagcacaaaagacggctctcgcccttcgaaggtccgggcccacaccggcgctgcgaccacaaagccgagcgcaagaaggccatagctcaatcccgtgatccaatgctgagagccgtagacctccgacatatagagggaaaagggcacctgcagcaccatcctgctcgcaagcagcaatcccatcagagcaagtagtccgaacacggacacccccgtggaaggcgcgcaagagactgttgttgctttcgcggttttcgtgagtcccgctcctcctagtggaaccggcaggcttgtccaggcgactgcggcacagaatgcgcagatcaccccggcggtgaggttgacggccgcaaaaggcaaggcgtcgaggatgagcccgccgaggaaagcgccgcccagggagccgacattcgtcgccacctgcagccaggcgaagaggcgggcgcgatcgcgcccgccggtgacctcaacgccgtaggcctgggccggagcgatatagccagcgcaggccccctgcagaaagcgcaacgccagaatggtccagacatcctgggcgaaggcgacgagcagttgcgtgatcgccaggcccagcaaggcccggaccatcatcaggcgattgccgtaccggtcgcccatacgtccccaaaaggcactcgtcagcgacacgccgagcatcgggcagacgtagacgccgatacccgcgaggccaaagacgctgtccgaggggctcaatgccttgatctgaatcggccagaagggaccgttcatctccatggcgcccatggagatgaattgaaggccgaacagcagcgcgaagaccggtccgaaaccgcgcaggaccgcgactgtcctggtcattccgcactcgccaacggattgggcaattggtgctcgatgcggtagtcgcgatagcgctcgagatgcatccgcaggaccgagcgtgccggccagggccgttcgaggaaggcctggcgttcctcgagccagaacgcatccgagagcatgcgcggccgcaacgtctcgaacgcctcttccgtttcttccctgaggacgcgccaaaggctgtcacccgcaaccgaatattgctcggtcaggcaaagggcgatctcgtgaagatggcagacaaagcacgcattgatgaggaacgagcgcacgaggctgatatcgtcgtcgaaggtggttggcaggatgccccctcgactgaacggctgcagctcataaccgcgttcggtgaagagcggtgcaaaactgcggccgtcaccgaaatcgcggatcaagagcttccgtggcaggccgcgatcatcgaaaagaatcgtgctgttttgttgatgcgcctcgaatgcaatgccgtagaggagatacatggccagagtcggtcggacaacggtgcgagcatagagccggaagaacgcagcgatcgccgcttcgctctcgtcgccgctttttccgatgagttcgcagatcagtggccggccgtcgacagggccagcggtcagaagcgcggcgacggttaccggcagcaagccatctcgacgggcaagagcatcggccttgcgatagaccaccgaaagaaagcggccgagatgctcgtcgccggtttcgggatgacgcagaatcgccccaagctcttcagtaaggatctccagcctgcacctgaggtcatcctcctccgacacaatgtcggaaatcagcgtgctgaggcgcggtcccatatggatcgacttcgcctgcagcgtccgctgctcgctcgtcatccagatcgcaaccggcagtttgatgaagggtcttggcgcctcggtcgtcggcagcatcgtgcgaaacgacatggacggcaacgtcacgatctccgggccgtcaggatcgaaaatgccggcttcgatctctgccgcgaattcgcggcgcacgaagtgctccagatgccaggcgtggacgggcagaggcagccagtcctcgggtgactggccccgcgctttcaggccctccgcccaatcgcgcgagaggtccgggaagttctcagcgaaccattccgaatagcttccgacgtgcggcatcttctcgacgtaggcccagctgctgcggagcgccgcaatgcgcaggggcacgcgcgcgccgaactcgggggacagtgcggcgacctcctccgccgccaggccgggcttggccttccaggtcggatagaacgggtggccttcgagcgcgccccattggtcgagggtcatcgcggccaaatgcgtcggcaagcttctttcgagataggcaaggaagccgggcgcaccggcttcggcgatttcctggcgcagcctggcgctccagcgcccgcgctcgcggcgcgccagcatgtcgttgcgcatgctgttgtccacgtcgcgcagcagatgctccagtccgtcagaagcgggcgtgatcgcgagagaggaggcaacctcccgcatcagggcggccggatcatcgatccgctgccgtgccccggtgccgtccagcacttcgatctgtccgcggttccgcaaggttccggcgggcgcgaggctgagatcggtgaagtgcagcatgcgctgcgagggccagagggggaaccaggcctggcggccttcgcgtgcccacagcaaggcgttcggcgcgagcaggcgctcggcgaacaggcagcgcaccagccggttgatcgcgttgcgcgatgcctgcgtcaaaagcgcaagatcctcgttctcgacgggattcgtcacggagggcgtcttctcgtccatcaggcggcctccggccagtcggctgggacatagtctggtgtacccgcagccaatttgccgtggtagtcgcacgcccagcgatagatcttggcgatcgccggtaccgtcgcctcgagccgttctgccatcgtgacgagcagcgcctgtccgaaagcgatatcctcgtggaaggcgcggcttccgcgatcgatgacgagccccgggccatgtggattgggaacgaggggggcaggaatgcccgcataggcgcgatttgtgcgtagaagcgtgtacatggttcggtcatccccaatctggtcgccataggcctcgatcagttcctgctgaagcggcttcactgagctgagatcaatgccgagacgtgcctcgctcgcccggcggatcgcttggttttccgcatcgcaagcttccaggagctcggcgcctgcttgtgggcagtcgctccaccagcacagggcttcgtcgaacggtcttttttcccacggtgcgccggggccgatgagcgcgtagagcacggccgggtgcatcagcgcgttgcccggcgtcagcgtgatttcgagatagtccttgagcaggttgacgggcgcctcgtagatgtgattcaacatcgccatcagtgcggcggcgctcgcagcgctttcccggcgatgcagggcaacgaagagctctgccttggcgccgcccatccgcacgcgctggcctgcaatcagatcataggcgatatggggcacgtccttcatgccccagatcaccacattgtcacgccccgaaagcacctttgccgcgagccagtcgaagccgcaaaagccgggaatcgcgccgatatagacgctcttatccgtcggcaaatacggcgctatacgatgcaagagcgcggatcttgcctgggcgggttgcgttatgaggaccatgtcagcgttgtcgagcgccgcgctcgggtcggttccgatgtagtcgggcctagcactcagggtgcgaccgtctcgcgtcaccgcttgccagagaccgtccccgctcgcccatcgcgcggccacggtggcggacgtggtcaggaccgaaacatcgatgcccgggttctgcttgaaaaggaccgcattcaaatgtccggtgcggccagcgccgcaaatggtcaccttcatgctgcccgcgcctttccgaatagccagccatccaactgggcagcgattgccgggtcgagcaggcggcgcttcgccatccattcctcatcgaaaatcgtgccaagatatttctcgccgccatcggcaaccgtcgtgacgacggtgccggtgagcttgccggcgccaatgaactccagcgccttgtagatggcgccgccggtcgagccgccaacgagcagtcccttgcggcgggcgatgtagcgcgccgtctcgaaggcttgcgtatcggtcacctgcacgccttcgtcgatgcagccatagtccagcaccttgccgacctcatcgccggcgggcgtgcccgttcctgactggtaataggggtgccccggcttgccgaaaacgatcgagccggccggctccacggcaatagtgcgtacggccggattgttacgcttcagacgctgggagattccggtcatcgagccgccggtcccgacgcagccgacaaaggcgtcgatgccgtcgggaagctgggcaaccagttcgtccacgaggccggtatagccttccggatttgccgggttgtcggactggttcatgaacagcgcgcccggaagctgcgcgccgagttgcgctgcgaggcgctggcgctcgacgactgcgacctcgtcttcgcgaaagtcgccttcgacatagcggatctcagcccctagcgcccgcatcatgcggatcttgtcgggcgctgcatggtggtccaccacggcaatgaagcgcagcccgaattccagcgctgcgagcgccagccccgtgccagtatttcccgacgatgattcaacgatcgtgccgcccggagggaggcgcccatcctgaagggccgcaatcaccatgctgcgagccatacgatccttcatcgagccgccgggattgttcttctcgatcttcagaaccaaggtggcgttgcggcccggcacgtcgatcgacatgaccggcgtctggccgatcaattgtgttacggtcgtgtgcagcatctaaacctctccaattgtgtcgggaacgagattgggccgcccttcggcgtcttcgatgacgcagaagcgagcgggcatgggatggcgatggaactcgttttcgaggaggtccatctggtagccgccggtgttggcgtatacgagcaggtcgccagcgcgcggcgcggtcgggaacgtcagccaccggttgctgatgacgtcctcgtcgaggcagctatggccggccagataggcgcggaccggcggcaattgaacggtcgccttggtggcaggcacgagaatagggtcgatcaggaattcggaggcgaaccaagtttcgcaggcgctgaagctgctaccttcgacaaagatgacgtgcgaatccggaccgagcgccttcacccgcgagattcgaaagacagtgatcgccgcctggtcggccagcgcgcggccgggctccatcgccagcgtgagaccctcacgcgccaggtagccggctacgcttcggccctggttcatctccgcctccaagagccggtgcagccagtcggctgctgaaagagtgctgccatagggatagaaagagtccggtattttcccggtgcggtagtcctcgggcgcctgcgccgcgagatgcgctttgtacctggctcggtcgacatattggataggcaggccaccgccaatatcgatcatgcccggaaaaaatcccatccgcctggcttcggcaatgaggtcggcggcctctctgagcgctgccacacgggtctcccggcgatagccgctgaggtggaaatgcagcccgtcgaaacgcaccctgccttcaccggcaagccgagcgaggcaatgaacgaccgcgtcgggcggcatgccgaagcggctcttgctttggtccctcggccgcaaacgcaagaggatggactgttggccagcatctgccggcagaccgtggatgagatcctccagttcttccggcgagtccaccgatatcagcgcgttgcaattgatcagctcttgatgaaatgcgctcgtcttcgccggtcccgtcgccacgagcctggcaccatcggccccaagccgccttgcgtcgcgaagctcgtagaggctggagacgtcgagcccggcgcctgcgctgagcgctgcctgcatgagcccgggcgatttgttggccttcgccccgtaatagatcgcatgctcgaggcggcgctccgtcagtacgcccttcaaggcggcaagattctcccgcaacgcatccggccagaccagattgagcggggagccgtggcgggcggcccaatcgaaaagaagaggaccgtatttggtgagaaggtccgcagtcgccgatcgcagaatcggtggcagcccatggccgatcttctggcaatgcagcgtcatcacagcgcccccgcggaaaagaccggcgcgatctccatcggagtgggactgctcaaaagctcaagcggcacatcgcatgtcggcaagccgtgggcaaaaacgtgccgggtcgtcttgtagggaaacttgcggccgctgcgcgccatcgcgaagatttcagccggagtaatgttcccacctgggcgccaactctctacccgcaccgaatcattgtcgaggagaaccacgggcatcctggtgagccggaggcgatgcgcaaccgtcaaccggtgatagtcgtcaatcacgaacaaggcatccttctcggctgttattggcgcggtccatgagcctgcttgcaggatttgggcctttagtgcatcgaccctgtcagggttcacctcttctgttgggatcaattgtgctgcggagagaaggcaatgttccatgcggtccggcctcacgctcgctctttcgcatcgcacatatcttgattatccgcgttcacgtctagtctcctgcgcgttcgctgcctcgtcgctcgcaaatgtgcaagcgacagcggccggcgaggcgcggtgaggatacccacatggcaaaatggggtcatgaactagccgggaaggccgacggcctaggccggatggtcggccgcaaggcgtgccttcaggtcgttcagatagccttctgcatagtgctgcgccattgaaagcggcagattaatcccggccgtcgcggcctcttcaatcgccttccttgcgagcccgttgcgaatagccagcttgaccccgggtcccgagacaaggccgactgcttgtgctgcgacccctatgccagcttctatcagcgcctgcttcatattgcctccggtaatcgctgtacggaggagatttgcggcttgcgcctcgcatgcaagcgtcatggatacgagatcggccacctgtccgattcccggaatgaagctgagcactcccacggccgttgcagcccagtcaagcactttagatcctacccgcagcacggagtcgacgacatgcatgagggctccgccgttctttttcggtgacttgatgtcaggctggtccgccaggcccatcttcatgtctgcgacagcgttctgcgcagcctcagtttccggcacatggaactttggctgctgaacggtgcggtttgccgtagtcatatttgtgtagaaacggccaaagtcttctttgctgacgttgccagaatcgaccgtatgtccgccaccgaagtcgaaaaatccatgatgagtcttatagcccgtaatcgcattgtttagcagaccgaacagaagaggatctgaaaggagctgcgaggcagcttcacgtactttcggatccaagctcttgtcgtctgccatactcgccagcttgtcgcgtgtgagatcaccgctcccgaaaaataactcctgatggctgttaattgtcttgagcgtgtccagctcggcttgtgtgaggctcatcgacgaggaggccacttgcaggaagtcctctttgtggaccttatctatattaccaccgtacaactgcttccattcttccggatgactgacgaagtattgagccgccgcaatgacctggggtggacatttgcctgttttcgcttcgccgtcgacgatctgcttgaagtcggccagactcaggttcttgggaagatattccgagtaccggtaaagctcccgtagagcatcgttctcggtcatgaccgatggctgggcattctcggcgctgtcggatgggatgtagttctgcgcgtagctttgcgcttggctttcctgaaatgcggcaacttgtgggtgatgtttggaaaattcagacaagtcctttgcactgatcttgcctccacagcgaccatcgccttgcgagccgattgcataaaaaagttcgggatcctgtagcaatgcctcgattgccgctttcagatccggcggagtagagggatcattggctttagcctccagcgactcccaactgagtgggcacagatccttgtgacggttcagcactgcgacaatctgcaactcaggcttagtcagcgatccaccgttccaggtaattctcgagctttgtatgggagctggcgcgacataatggtcatcgatcacaacagccgactgcggggtctgatccattgattcgatcgccgccctcatgtgggggggcagtagggccaaagggtccttctgcaaatcctccaaggtcgactcggcatccggcggcggcaggtcctcccgactggctaaaggaccaatcctgtctagcatgttagtggacagcatcgcctcgaaggacaatacgctttgctgcccctgggctacccgaggcgcgaaagctttggcgagcgacgcctgggcgaactgtgcaggattagagctgatcattggtaaaaggttgctggccgacattgtgcatcctcagacgtgatgttgtccctccacaaggaccttctataaggcgcttgcgctcacgaagtgacaatcttaaagcctcagctggagtaaccgtgcttttgattgcttcgctccatgctagctacaaaggtcaattccggcacaatggtcggcgacatcgttggagctaccgattcacatcatgagcggtttagctttcgagaaactgacgaggctcagacgaataacaatcaagaggtgaccgcagtgaggttctaatcctaaagtctgaatttcatttcttgctcagctcagccttcccgccatcgtcgttctctggcagcatctcagaagtataaaagacttccggtctcccgccgcggacgaccgtggtggaggagccccgaaacagtaccatcacagattccctggcgggcgtatcggttgcgcgaggctgcgcctgcgccactgccagtagaccgttcaacgtctgctcgatgagcgccatgaagcgcggcgggccggacactaagaccaggccatttcccggcgcgggtctcaccggatagcgctcatcagagatgtcaagcttatcgagggcgagcttgaaagcactaaagtgaactgaactcaacacaagcatccgagtttgtgcttcttttgcagcagacacatagagcacaaccccgtcataataccattggagatcgtagagatcggtcaatcggtcgaggaactcgcgcggtgacaactccggtatacgcccgcgaatccgccccttcacctctgcgctgatgttaacactgattttcaggttgttgccgaactcctgcaacgcggcagagagatcctgatctagaaccgtatacttataggaggtcgaggggagtggcagggtggccccgagagttgtgtggattccggcaaatagaaaaagcccgacacagagcagtctcctaaacatatgaagcggtgtgaatgggatcggcgttgtcggcatctcgtcttgataaaccaaatctgaaaatctcccatgcggttcaactcgactaacatcactcttcaatgggcaagcgacgctgccggtagtcagcgtgtcgtcagctcgcctcgctagagttccacgtcaaagagttaagtaatcgagtccttctcatgatgctgcctgtcacgtcaatctctaacagtctccccagggtcgcgtcatcgtcattcggcgagcaggctcagtttgagcgtgctctggcacaggcggctgattcgatgaaaaacgatactgcttcaacgccagtgaggacggcgcctatttctccgccgatggacgttcaccgcgcggcgccaacgagcccgctggaggatcgcgtgctgcagacgatttcttcgatttgcccggatagtatagttgctgctgccgcgcccaaccataaggcggcccttataagcggcgctccgcccgggccgtcgcagaagctccctgtcgaaggtggggcgggcaccgaaaggttgggaatcccgcaaggggggcatgattttgacgtgatggttgccggtctgcgggatctttataatggcgtgacccaagttgctcttgtttcgaagggtatcagcggcatcacctcatccgtaaacaaactattaaaggaagggtgagttgcgcgcatgttcggctcagcccatggcgacacaacgagcagcgacacgtctggccggcgaccgcttcgcctcgtcgtgctgccacttctcctggctctgagcagttgcaaggtcgatctctatacccagctgcaagagcgcgaggcgaatgagatgctcgcgcttctgatggacagcggggttgatgcggtccgggtggccggtaaggatggcaccagcacaatccaggtcgacgaaaagttgctcgccttctcaatcaagctcctgaatgccaaggggctgccgcgccaatctttcaagaaccttggcgaaatattccaaggttcgggcctgattgcatcaccgaccgaggagcgtgcacgttacgtctatgcccttagcgaagagttgtcgcatacgatcagcgatatcgatggcgtgttctcggcgcgtgttcatgtggtactgccgcataacgacctgctgcgagcaggcgacacaccgtcatcagcctcggtctttatccgccacgacgccaaaacgaatctcccagctctgctgcctaagataaagatgctcgtcgccgaaagcatcgaaggcttggcctacgacaaggtagaagtggttttggtgccggtggaaaggtccgcacaagagcaacggtctttactggcgactgacttggctcaagcatctaggcctatcccagagccgctcctggctgtcgcggtgggtgtttccgctgcagtgttcgctgtgacgtgttacctcttgttcatcgttcttgggcatcggcgcaggcaattaactggcgaactatctagagtccaggagcgccccggtgtttccgctctcgcggctattcgtaaaaagataccggggctagggcgtaggtgaaattaccaatgccgatagcgatacagactacccaacctgatgtttcgttccaatcgcactccgtttccaggagcgagcttgctgcgtcgacccatccgacgcgtcttgccgcccgtctcgatccggagttgtcggctgcgacagtggtgcagttgcagaagtgtgcgaggcttcagccacgactggcagaattgctgcttggcaatgacatggattggaaccgaatcggatgggggcccgatctcctgcgcggccatgatcctcgtcgcgctgctcttcttgccggaagtatttggcatgcccgttcgcttctgaaagtcgtttctcagcgtgacctcgcccggctcgttgaacgtattggcgctgatgcgcacgcatttggcatccgacatctggcgcatgctatcgcagacaaattgatctctgatccggaaaaacttgcgttgcaaatcgaacacgatggacatgcttgtcttggtgcttggctcaacataaggccagcgcttgagcggaatcgcgtgcttctacgcttgccgctcggtacagccgcggagaacccggcgcctgagcacgatggtgcctcaagcgggttgttttcgctcgtgatagcccatttcgagatggagagcccgtaatatgacagccgacatttcagcggcacccgtcgcgccgcagatgcgcccattggggccactgatacccgcgagtgagcttaatatctggcacagcgctggagatgcgcttgccgcagcaaaacggcatcagcagcgggtccgtacctgggcacgcgccgcttatcagagggagcgggcgcgcggctacgccgaggggttgaatacaggcgccgaggaaatgtcagggctgattgcacgagcagtcaccgaagtagcgcaacgaaaggcagttctggaaaaggaattgccacagcttgtcatagagatactgagcgatcttttaggtgctttcgatccgggtgagctgttggtgagggctgttcgtcacgcgattgagcgcagatacaacggcgcggaagaagtttgccttcatgtgtgtcccacgcaagtcgatatgctcgcgcgcgagttcgccggttgcgacggacgggagaagcggccgaaggttcgaattgaaccggatcctacgttgtcgccgcaagagtgtgtgctgtggagcgagtatggcaacgtcgctcttggacttgatgcgcagatgcgcgcgctgcgccttggcttcgagtacctttctgaagaaggagaactgtgatcactccggtaccacagcataatagccttgaggggactcctctcgagccagcgatctcgtctttgtggtccacggcaaagagaatcgatacgcgcgtcgtgcgaggacggatcacgagggctgttggtaccctgatccatgccgtcttgccagaggctcggattggggaactttgtctgctgcaggatacgcgaaccggactgtcgctcgaagcagaggtaatcggcttgttggacaatggcgtgctgctcacgccgatcggaggcttggcgggtctgtccagccgcgcggaagtcgtctccactggacgaatgcgtgaagtgccgatcggccccgatttgcttggccgtgtgatcgacagccgctgccgtccactcgacggcaaaggcgaagttaaaaccaccgaagttcgtccgctgcacggcagggcgcccaatccaatgacgaggcgcatggttgagcggccattcccgcttggggtgcgcgcgctcgatggtctcctcacatgcggtgaggggcagcggatcgggatttatggcgagcctggcgggggcaagtcgacgctaatatcacaaatcgtaaaaggtgccgccgccgatgtcgtcatagtcgcgctgataggcgagcgtggccgcgaagtacgtgaattcgtagagcggcatcttggggaggaaggcctccgccgtgcgatagttgtggtcgagacctccgatcgctcggcaactgagcgggcgcaatgtgctcccatggcgaccgccctggcggagtactttcgcgaacaagggctgcgtgtcgctctcctgttggactcgctgacgcgcttctgccgtgcgatgcgcgagataggtcttgctgcgggagagccgccgacccggcggggcttccctccttctgtttttgccgccctgccaggcctgctggagcgcgccggcctgggtgagcgcggttcaatcacagccttctatactgtgcttgtcgaaggtgatggcacaggcgatccgatcgccgaggaatcgcgcggcattctcgacggacatatcgtcctctcacgcgctcttgcggcgcgatcccatttcccagctatcgacgtgctgcagagtcgcagccgagttatggatgcggtcgtttctgagacgcatcgcaaggcagcatccttctttcgtgatctcctcgcgcgctatgcagagtgcgagtttctgatcaacgtcggcgaatacaagcaaggcggcgaccccctaactgaccgcgccgtcgcgtcaattggtgagttgaaagagtttttgcgccagagcgaagacgaggtatcagattttgaggagacggtcggatggatgtcgcgtttgacctcgtgaattatgcttacgcttcaaggctacggcttttaaaggaaatgcaagagcgcgacgcccgtaggaagctgtcgaagaaggaagctcagcaccacatggccatcgtagccgcacagaatgcctctcgggagcttgaaatcgcacagcaacagcgtgctggaaaggaagctcaactctaccaagaactgacatcgctgaacaccttgtctagcgccgcactcgaccatcaccaccttcatatagagcggcttgcggctgagatcactatccgaggccaggtacttgacgacgcgcgcatcgctcaagagcaggccgagacagcggcgtctgagacaaaggccctgtgggtgaagcgttcggaagcacggcacaaatggcaacagatccaggacgacctccggcgcgccgtcgatattctttctgaagccgcaggtgagatagaggccgacgacgagatattgctgcggtatgggaggggttcgctcgaccagaggtcacgcaacgagttccggtaactgcaagtttctgattgaccgcacgtgcagctaagatccgctttgatgactggcgtggccagacgcaccatattcgaaccagcgctgacactgtcccccgaggtcgtcgcgtggatcaacgacatagcggcttcacgcgggccgtttcagagccgtgtcggcgacaaaccactttcggtgtcgatggaaggacttgtttggcaacacgagtcttctgccattccgatgtttgactgcgtttgggatttgggaggtgaaacggtcgtcttgtcgctctctcggccgcttgtagaggcgctcgtctcgacagtgcagagcgggcttgcttttcctaccgagccaactgcatcgctcattctcgaacttgcgctcgagccgctcatcgctcgactggaggataagacgaaccggaccttgcatctccttcgcgtgggtaaagccataacattggctccttatgtggaactggagatcgtcatcggcccggtcagtggcaagggtcgcctgttcctcttctcgcctcttgatggcttggtgccgtttgcgttccgcgcgctggccgaactgcttgcccagttgccgcggcaaccgcgcgagctttccccagagcttccggtgataattgcaggtgagatcggcacgcttcgagcttcggcggcgctccttcgaaaagcatccgtcggtgatgctctgttgccagacatatcgccgttcggccgtggccaaatcgctctgtctgtgggtcagttatggaccagggcagaccttgagggcgaccacctagtcctgcggggacccttccgcccgcaatcacgccccttggagtgtgcgcatatgacagaaatcgaatcgcaactaaggccgtcggatgccgatctcgatgacatcgagatcgtgcttgtctttgaatgcggccgctggcccatctcgttgggcgaattgaggagtgccggcgatgggcatgtttttgaacttgggcggccaatcgatggccttgtagacatagttgccaatggtcggtgtatcggacgtggcgacatcgtgcgcatcggagatgatctgggcatcagactccgtggaaggttggcatgcaatgactgaaatgcagccggcaattctggcccttcttgcgataaccgcggcactcggcttgctggtgttagcggtcgtcacaaccacggcatttgtaaaagtatctgttgttctattcctcgtccgcaacgcactcgggacccagacgataccacctaacatagtgctgtacgcagccgcacttatcctcaccatgttcgttagcgcacccgttgctgagcagacctatgatcggataacagatccgagactccgttatcaatcgctcgacgactgggctgaagccgccaaagcaggaagtcagcccttgcttgaacatctcaagaagttcacaaacgaagagcagcggcgatttttcctctcctcgacggaaaaggtctggcctgaggaaatgcgcgctggagttacagcagatgatttcgccattcttgtaccatcttttctgatatcagaactaaagcgcgcgttcgaaatcggcttcctcctttatctaccctttatcgtcattgatcttatcgtcacgacgatattgatggccatggggatgtcgatggtatccccgacgattatagctgtcccgttcaaactattcttgttcgtcgctattgatggctggtcaagattgatgcacggacttgtgctcagttatacgatgccgggagctttatgatgaccggatccagtattgttagtctaatgagccaatcattggtggttttcatgatctggattctgcccccgctcattgcatcggtgattgttggcctaaccattggcatcatccaggcagcaacgcagatccaggatgaaagcctgccactcactgtgaagctcctggtcgttgtcgcggtgattggcctgtttgcgcctgtgctgagcgctccgctcatcgagctcgcggaccagatctttaccgagtttccagcaatgacactcggctattagtctgcgctatgtatttgtcacctgccgagattcagatcttgctccatgcggctatcgaactcgttgcggcagccggtcttggagcggcccgcgcgctgggcataatgctgatccttcctgtatttacacgatctcaaattggcgggctgatccgcggctgcctggctatcgccttcggactaccctgcttggcacacgtcagcgacggattgcaggcgccggatccggaaacaagtctgatccagataccccttctcggactaaaggaagtgtttgtcggcgtgctacttggcacttttctcggaattcctttatggggccttcaggcggcgggtgagtttatcgacaaccagcgcggcatcaccagcccgtctactcaggccgacccagcaacgaacagtcaggcttccgctatgggagtatttctcggaatcactgcaattacgatcttcgtcgcagcgggaggcgtggaagctgtgctgagcgccctctatggtagctactcaatctggcccgtatatcggtttcagccaacattgagtacccaaggcgcagtggagttattcgggctcctcgaccacatcatgcgcacgacattattagtctcggggcctgtagtgttctttttgggactgattgatatatcaatgatgatgctacgtcgctttgcgccacaattcaaatctggccagctctccccgccgatcaagaatatcgtctttccgatcatcatggttacctacgctacctatttgctcgagggcattaaacttgagatcacgcaagcggacggcacgcttgggtggctcgacaagttgctgaaatgagcgatacgagcgaagagaagtcacacggcgctacccctaagaagctgagcgacgcgcgcaaaagaggtcaaataccgcgtagctcggatttcgtccgcgcggccgccacttgcgctgggcttggctacttatggctaagaggtagcgttatcgaagataaatgcagggaagcgctactattaaccgacaagctgcaaaacctgcctttcaatctcgcggtccggcaggcgctggttctgctagtcgaactcaccctggcaaccgttggcccgctgctctcagctctttttggcgcggtaatcttggctgcattactggccaatagaggatttgtattctctctcgagccaatgaagcccaacttcgataaaatcaatccttttcaatggctgaagcgcttggggtcggcgcgttcggcagtcgaggttggcaaaacgctgttcaaggtgttggttctcggcgggaccttttccctcttctttctcggtttatggaagacgatggtctatctgccggtctgcggaatggggtgtttcggcgtcgtctttaccggagcgaaacagctgatcggaattggcgccggcgcacttctgatcggcggactgatcgatctgctgttgcagcgtgcgctatttctgcgcgaaatgcgcatgacgaagacggaaataaagcgcgagttgaaggaacagcaaggaacgccagaattgaagggtgaacggcgtcgcattcgcaacgagatggctagcgagcctccgcttggtgtgcatcgcgccacgttagtctacagaggaactgcggtgctgatcggtctgcgttacgttcgtggtgagaccggagttccgatcttagtttgccgcgccgagggcgaggccgcttcagatatgtttcgcgaggcgcagaatctgcgtctcaagattgtcgatgatcatgtcctagcgcaccaactcatgagcacaacgaaactgggcaccgccatccccatgcaatatttcgagcccatcgcgagagcactcttggccgcaggtttggcctgagcatccctgaattcggaaaagaactttgaagacattgacttccgggcgtgattcctttggctttaagtcgggacgcaatggatggcccaggaagaaacagtgctgccgcaagcacatcgcacggcgggatcatctggcaatcggtttctgcgaatggcggcaaacgtggctcgcgcttgtcgttcaggtttggcatgtccgccggtggcgacacgttgtttcaaatggtagttgtggctgagaatcgatagaggtgccgcacgtgttggggtcggacgtaacggcggccgcagggacgctggtccggcgcccccgccatatccgtgcgtgcagagttcccgcgtcatgacccgtgcccgggctaaagcaacagggtcgtagatttcgaatgacaacacgtctgtggcggacattgctcgtcgccacgagatcgatcggtcattttttctacagatggcgtcaaatgctgcgaacctctgcgataacgtcgacgcttcagcaaattggaaacgcggcggcgcaaacagttggcttaagcccaaacttccacgacacgtccgttccagccagatctgccacccaagccgataatggttcaatggttccgagctccggccgtccgcgcaagcagcaacagagccagtgaacccgagtatcggcaaatagcggcagaaagctttttgtccgcgctgaaagtcccactagtcagctgaacgtcagttgtgcgcgtctatcatcttgacccgttttccctaccagtcgctctcagtgcaaaaaaataggagtacaagatcaccatgtacggtcgaattgatagctcgtccgatttccattacacgcagagtgccagcaagcaaatggatgcagaaacccaagagttcgcggacacgtttgcccgaatgcacttagacaggtccaacggcggttcatcgtcggcggccagatataccctcgatcacgaacctccggtggtgccgattgatctcgagactttcaggagggagatcaggaaatttcatggcaaagaaatcactgacatcgccaacaatccacaggaatattcagacttcgtgtccgcaaaagccagacgcactgcggacgttgctcagcaatacggcattcgtcgggattctgagaacgctcgatatttcagttaccagttgggaaaccagtgtgttggactgatgagaacggaaggtgggttcagcatggaagaagagttcgaatccaaaagttggagagaccaatttcctggtcaccaagagattacctccaccgtggatcttcaagtcgcccatcctctcgttgagaatgcaggcgatattctgctcgagcaccaacttcggagggacggcgaacgaccgttgctgaactggcgcgcggaaaacccagaggcgaaagcccgtgcagcgatgatggggtttgttgaagtggatgattgcgacatggtccttgaccccaaacagcatcccgacaaatggacgcagaccagtgccgctgaatggcggcgtaaagacaaaccgccgctctatctccgcaaatttgaggatgccgaaaccgcacagtgttcaaccagctgctcttacgagacttacgaagatgacttcatgtgaccggattctcgccagatttggtcgcgacggccggccccatctgccaagaccggccctcatgtcacggacagggaacgaaagagcgttacaaactgccacgcgctaacgagcgatacccattcggtgtttaggcgcaaaggggcttgaacgcagggtttctttgagaccatcgtagtagttcgttcggggttttgcacccgagtcccgtaaaacacctcgaggccgttctttacattgaggccggagcgtctttgatgcccggcctcttttgccatcgggtggctccgacaccgcaatggcgatacgcaaagcagttggtctcgccggcccgaagtttcgtgtaaagcaagcctttgcgcattcgaggcttcatcgaacctgagagagcttcacgctcgcgcaaaatgccgaatttctcgccctgctggtccaactgcacacgttagcgtttttttgtcctggagccgaccggcttttcgaacaggttgtcgcttgctgtcggctgcccgttgtatgctatgtcactcaagtgcatcggactgagcgccgcctcggcctgccggagttccagggagtccagatcgtgcagcacgtttatatgcaatagcgcttctttttttgacaattgtcagcttttcgaaagctggagctcataagtagatgttatctacaattcgccgctaaggcaggagtagctgatggtcggagtgattggaagtggagttggctccatcggcgtttccctggcccgcaaaggggggcatggacattcgactggacagccgccgcgcgattcaggcgggccctctggtcacaacaggccggatcgcgggagcggcgttacggatggcccgaccatttctggggatcgctcgcaggctgcaattcaaagcgaagccttcgaactagctcttcgatcggttgcgctacaacttatgaacgatgccatggctgatgccgacgaagctatggcagaaactgaagaggatgcctgacgctgggtggcccccgtcaggaggtgcgtgccgttagtgacggcacaattgtaacagaaagggaaatgacatgtctaaaataggtactctcacgagtgcagttggagctggcgccgcggctggccagaacgtagcggccaaaggtgctggggctgcggccttccaggcccaaatcgcagaactggcagcggtgagcgcagaggctacggctaggagtatgctactgcgcactgttacgaccgagctccagacaaccaagaaggcggcggatgaacgcgtacagtgatgcggatggggctctaggcactgcgtagcacaattggcacgaagtggagccgagatgagccgcatgccactcgccgtgcggcttctcttttgtctggatatcgtcagtgaacgacgccatttcgcttcaattcaaagttatctcagggctctattgtgaactgactggtacgacggctctagaaacgagcttgatcggtagcggcctcgacgccgacatagtgttcgtcgagcagggcctcgcgccgcatcattttcgcgtcactcttctgggcaaaacacttgaggtcgaggcgcttgctgccggtctcagcatagagggaaacgggaatattgccgcaggcgagcgggttgtcgcgccccttcctgtcgtcattcatgcaggcgcgatgtccattctctggtcagtgcaggatgcagcgtcgtctggttcgatcggtaaaccacgcctctcgatatctgtgctcgccttggtgttgctcggttctctcgggatcggcgtgctctcggccattttctcttactacgacaacgctgttgtatcgaacgccgatttatctggtgaggcccgggaacccaagctgcctgataatcgcactgatgatgagactgcattcacagccgctaaagccctgcaacaggaagtcgacagagccggtctgtccaacattaagatcagcgccgctgagggtgttgtgacagtcgaaggcacggtcacgtctgcttcggccatcagttggcataaagtgcagcagtggttcgatcatcggacgaggggcgctctagcgctgttgaatggagtgattatcgacgatgagaaggcgccatccgcaatcgcagtcgaagctgtctggcgtgggtcgcttccgtatcttgtcatcaaaggagagaaatatttcgtcggcgctcttttggatgatggttggatggtcgaacggatcgaggacggtcgtgtaatgctaagccgaaatggccgccttgctgctgtcccgtattaaagtattccagcgcagggctgacgatcttggacagacttgatgaccggtcaacttcgcacttgcctttgaatcttatgcgcagccatccgccgcaggggtcggcctcacggacgacgcgcctgcggtcttagagctacgttgcacctgtgtagcagcagagtggttcagaaacgatcgtgaagggacctcatggccaacgccctgcgtagattcaccgagtatgcgccggccaatccggacttgatggtcgcgttgatgctgcttctggccgtcagcatgatggtcatgccaataccggtcatggcggtcgatgcgctgataggcttcaacatgggtttggctgtactgctgctgatggcggccctgtatgtcagcacgccacttgatttttcctctttgcccggcgtcattttgctttccacggtattccgtctggcgctcaccgtcgcgacgacgcgactaattctggccgagggcgaggcaggcagcatcatccacacgttcggcagttttgtgatctcaggcaatattgtcgtgggtttcgttatatttctggtagtgaccatggtgcagttcatggttctcgcgaaaggcgccgaacgcgtggcagaagtggcggcgcgcttcaccctcgatgctttgccaggcaagcaaatggcgatcgacgcagagttgcggaacggtcacatcgatgccgacgaatcccgcaggcggcgcgccgcattagaaaaagaaagcaaactttatggggcgatggacggcgcgatgaagtttgtgaagggtgattccatcgccgggctagtggttatctgcatcaacatgctgggtggaatttccatcggcctgctctcgaagggcatgtcgttcgcccaggtgctgcatcactacactctgctgacgataggtgatgcgttaatctcgcagattcccgccctgctgctctcaattacagcggcaaccatggttactcgtgtaactggggcttcgaaactcaacctcggtgaggacatagccaatcaactcaccgccagtacacgagcattgcggttggcggcctgcgtcctggtggccatgggcttcgttcctggtttccctctgcctgtcttttttatgttggccgcagtcttcgcggcggcaagcttcgtcaaaggtgacgtcctagatgccgacaaagtcgatgctacaactgtaactccggcggagtctcaaacgccaaacgtggctgcgcagccaaatcccattggcgtcttcctcgcgccgagccttacgaatgcgatcgaccaggtcgaattgcggcagcacattgcgcgtatttcccaactagtctcggccgatctcggcattatcgttcctccgatcccagtcgatgtcgaccagcagctgcccgagtcgcaattcaggatagatgtcgaaggcgtgccagtcgaacaggatttgattaatccggcgcagctgtccctcgcagacgatctgaagaagattgagtcaagcggcatcccttttcggcatgatcctgaaacccacagaatttgggttgaacaaagccacgagccggcgctcaaagccgccggtatccggcatcatagtcccagcgaactccttgcgatgcgtgtccatgcgacgttgacttgccatgcgccgcgcttggtgggtatccaagagacccgccaactactgggccggatggagcaggaatactctgatctggtgaaggaggtgctgcgtaccacgccgatcccccggattgcagatgtgctgcgccgcctcttgggcgaaggtataccaatccgaaatacccggctcgtcttggaggcattggccgaatggagcgaacgtgagcaaaacgtcgccctgctcacggaacacgttcgttctggaatgaagcggcagatctgtcaccgctatggcagacacggtgtcctacctgccttcgtcatggaacgtgagactgaggatgtggtgcgctgcgcggttcgggaaacggctgcaggcccctacctcgcactagaggatcggcaaagcgaggcgctgctgtcacagatgcggcaggtcttttcgagcacggcaccgggccagacgcgcccgatcgtcttaacttcaatggatgtccgacgcttcgtccgcggttttcttacccgaaacggtatcgagcttgccgtactgtcttatcaggacctcgcctccgattttaaaattcaacccgtcggatccatcaggctcccgcccagtaatggaacgtcaggggaacctcgcagtatccgcccttctgccactactggatgataggtgagaaccaaacatgaattcacatgagaatagagtcgccgcgccgttgctttcatttcgtttgagcttagttctcttcgcagtactctccgttctgcctctcggcggttgtgctaggtgggataaccccgttctttcagtgaaggagacgtcagccgcacaattgctcggcgccaaccaaatcaatgcggctacgcgccaacgcattttgcgcgccgtcggtgaggacgctcaagagcgggctttgcgggatgatctgaagcagcatccaggcaatgtcgatgcggcaatccgtcttacaaaagcattggtggcgcagaaacgtccgcatgaggcgcttcaggttttagacaacgtcttggtcgtgaccccagacaatttgcgtgcattgaatgcgaaggcagtcatcttggacattgaggggcggcatgacgcggcacaagagctgtaccggcaagctctcgaaaccaacccagagaatcagatgttgcaccataacctccatctgtctcttgcgtttgaagggaagtccgaacagaggactttgccacaatcgcgataacgttgctgtgatgaattcacctttgagaagcagacgcagcacgtcgtgcgtgcctggggacgaggcaggccctatagcaattgagcgctgaacacgacattaaagggacggaactgagcggctaatcctattttctgacagcggctctggtttgaattggcgctgtgtccgtggcgctcgacaccgagggcgcggccggcgcgcggcgtacagcgttttgtcggtccggttattgaccttgcccgcatccgcctatctcagggtcgcgttaccgctgaactcactgccgttgtcctgacgatcatcatcggttcgctgcgctccaggataaatcccagccgagctcacgggtgcaacacgcaggccagggccattataagagtagtgcgtaaagggggctcatcaaatggagccaatttggttccctaggcgattaaacagcatgcggcatcaaaagtgtcaccctacagaatatttatagcattaatattgccccatagtgttgcttctgcgtaaccgtatttaacatagggtcaagtgcgtgatgcctatacgcggacaaaacgaaactattccctcaaataagcagaaggatgtcgacaagaccttgaacaaacttggtacgaagttttctggcacgcgtgataagcacctaggatacccgtacaacctcgactttgaccacagaccaatctctcaatcccacaaatttctaaataacatgggtgccatatgtcggctcacactatgcgaccgaggtctgtgactagagtgcgaggtggtcgactggaccatgcgggtcggggagtgcgctgatccagaagaatactggggaactgtgggcgcaagtgaaactgaaggtaatcgatggccatataccttgcgcgcgagacccttgataatcctattcttatacactcgacagagggtagtgtgctgaaggttctgcagaattctctgagaggggcggttatggcagcctggtgatgacgaacgtggatcatgacgtgctgatcgcaacgctcgaccggctgaagctgacggcgatccccgaccagctcgacacgttgctggacgaggcagcgcgttcgcgagcgtatcgaaagaacgatcaggcttgggtcgagcagaagaacggcgcgatcgtgcgacggctggtcggttacggaaggctcgtcggcgcggaggcgacggttgtgcttgggcggctctacgacgtggtgcgtctgtacggcaatctgttccagccttcgttcaagctgcgagagaagacacggatcggcgcccgcgtcgtcaaacgctaccatccgcccgtgccgcctatcgcgcgggtggttgcccattccggtgtggccgaggccgataaggagcggctgcaggcgatgttggaaagggaagatccggtgatgctgtttgccggaattcgtgccgcacaggaggagctcggaaagcgggtcgatcgccgtggcttgaatgccgggaccgaagaaccgctcgccatcgatctgcagcgattcaccgtgagcttgaagacagcctggcaggctggagagaaacggccgacacatcggcggccctatcggcgaaccaagccttacccgaaaaggccgagcatgctggagccattcgagccccagattcgagcgtggcttgaggcagatccggcgctctcggcagcccgcggtgctccagcgccttgtgagcgccgatccgtcacgcttcaccaagaaagcgctgcggacggtgcaaatggccgtcaaggcttggcgcatggaaatagccgggcagatcatactcgatggcaactggatgaagcgcgcgcccgtatctcctcccgccgcggcgcagggctgtccggggaaagttgcggctgaatcgaaatgtcgcaggcgcatgccccgtcagacggggattttccgtctaccttctggttgtcgagactcagaaagaggacggggcatgcggttcacacgtagcattcttggcaagctgattgaaccggtcaatcggcgccgcttccagacgatagtggatgatcacgacggggacgcctacgacaaggcgttccgcagctgggactgctggtgctgatctatgcccagttgagcggtgcggagagcctgcgcggcctggaggccggctggaacgccaacagccatcaccactatcacctgggcagcgaccgcttgccgatgccaacgcccgccgcccggttgccgtctttgccgagaccttcggcctgcttgccggccaactcgaccgacagacgcgccgcgagggccgggccatgctgcggctgatcgattccaccccgatcccgctcggcaagctgtgcggctgggccaagtcgaacggccgcatccgcggcatgaagatgcatgtcgtctatgaccccgacagcgactgcccgcgcctcctcgacatcaccgatgccaacgtcaacgacgcccagatcggtcgcaccatcgccatcgagagcggcgccacctatatcttcgacaagggctattgccactacggctggtggacggcgatcgccgaggcgaaggcgttcttcgtgacccggccgaagtccaacatgggcctcaaggtggtgcgccaacggcgcatcaaggtcgccgagggcgacggcttcaccgtcatcgacgacgccaccgtgcgcctggccagcaagggtgattccaagctgccgatcccgttgcgccgcctcaccgtcaagcgcgccgacggcgacaccatcacgctgctgaccaatgatcgcaagcggcccgccgtggccatcgcggcgctctacaaaggccgctggcagatcgaactcctgttccgctggatcaagcagcacctcaagatccgcagtttccttggcaacaacgacaacgccgtgcgcctgcagctcttcgccgcgatgatcgcctatgcgctactgcgcatcgcggcgcgccttaaccgcatcaccatgccgatcctgcgcttcaccgacttggttatccgctgcctcttcgagcgccgcgacatcgccgccatcgagcggccgccaccggtcaatcccagccacaggagaccccggtgctccccccatcaaatgagcttcgcctatgtctgaatttccccggacagccctgcgccgcggcgggaggatatacgggccatctcagtgcccccaacttcagtaacattcctggatgaggcaatagggggggtcaattctccgattcgcttgacatgccggctctatctcccccgatgctctctcagaggttattcacgcaaatcgccatcgcaccgtcattctcgcattgacctgtggaccgaccatgaaagggggcgcacgacgatatcgcgtcctgcatcaaggttctggaccaagtcgggatcgatccgaaccgacgctttgtccacgtcgagggcgcgctgaatgcaatggtacttccctttgtcgatggcttacagaggggcatccgcccttctttccgccgtcagctacctgcgcagatgatgcgaccccgatgggatcgcgaaacggccacgccgttctcgcgatttggaacgggcgcatgcgccttgacatcgctggtttccgcaacaatcttcgtgcctgcatcgaacgcgcggagggcttcgcagcagcacttcgctcagtgggcgtcttggtattgctcaatccgtggtcattgacggttgtgtttccaaaacaatcggggaggctcgtcaacgaatatcaacacgcatgcaatggaggttctgcccacgcgatcgtcagccaagcgtcaaagcagatctcatctatgatcatggccttccttggaggcagcttcctgattgctggtgacggcctgacgaccggaagcattgtcgcgtcagcctcgctcttgtcgccggcctaggttacgccagctttatcttcgcatggaagcttttccgcgctcttcgcagccgtgttcttcggggaatggctaacaggtccagagtgtctgcggcactggctatcgtcgttggtgcgttgatcacttccatgcctgagcgccgtgtcgccttggatgtttctatgcgggcgtttatatggcgctgctttttgtggtggttgacctgcgagagcatcggcccgagccgccgcactacaatagaaaacctgtcgccgggggatagtgaatgtgcgcggcggactacggtaggtcagccgccgttgcaccgtgcctggtgcgtgcgggcggtcggccctcagcaggcgctcggcccgtaatcgggcctcgccaccgccggcatgccgtggctcgggtcctccctgcgcttacacggacccctgggcacgaatatcaggagcagggcttccggcccggggcaggggagtagggaatcgcatttgactattttggttgcatttggagggccgggggattcttgagataggcagttcgtggagcagaaaccgccattccttatcttgaaagctgtttcggggcgtctccatgcaaataggcccaattggcgaaggggagtagggcaccggtcgatccttctcccgacgaactgctcaagcacgtctcgctgctcagttcggagcacatcagtcgcgatcgtcgcaagcagcggatggtgccgccccggcgcgagtgggcttgaatgcctgaagaaagactccagcgagcttacggacgtatgcatgttgctcggtcgccatcaccgataagttccctttctccacaatcgcctcgagactgggcttgatctgcagctgccgaatccagccgactttcgatcgcatcttcatcggcatcattggcagcctggagggccaaaatcgtgtggcggaacagtcgcagcgctccccgatcccgctcagggtttcaacatcattctcggtcaggagcgcggcaccaggagatcgccaagaattgagcttctacagcgggtcggctatcgccaagcgcgggccatttttgaggcagcctacaccgttgccggcatagctgaagcttaaagaaaccgatgcacctcgcgaggtgagcaacggaccgtaagttcgccgtcagcttaacgaagcatcgtgcgaagcgcggtctaagcggccccatattggcaataaccgtgcgaagggaaacgaacgccatgcacagtcccatcagtggttcattcacaagctctacgcaagttcacgatccgattcatccagcgaacagcgatggtttcagggagacgcttgcgaatgttgaactccggacgaaatcaccaagtgcggagtgccccgataagatggggtgctgcgccagcaagccacaagcatctgatccgaacaatcccagtacctcctctcctgcgagaccgagcacctccctgttccgatacaggacggccgaattggcccaggcgaacgcagatggaatctgcgtcggcttgactgcggagtggctgcgtaacctcaacagtcatccgtcaatccgaatggaggccctagtacccggatcgcaaaggcacgcctcagccactgttcggcagaaggagtacgagaatctgaaggttcacctccgaagacaaggagcaggaccttctgaggccgacttcgcggcgcaaaacactatgttgcagaaagcaggccttgctccatccggaaaggagaaagtatacaaagtcggcgagcctaacttcccgcgcatgctaaccaagattacagccgacggatccaaccatttgctcagcttgtatttcgctgagggcggcgcacacaccgttgcgacctcggcaatggatggaaacaccacgctcttcgatcctaatttcggcgaatttactgtgcaatcagatcagatagatgatttgttccgaagcctagccaatcgctacagcaatccaaaccggcagcatttaacaacggtgaccacccaaaagatgacatgagtcgggcgtcctgcgcggcgtagtgttcactgaagtccacgtaaatcctcgtcgatgcttgtgctgaagaggtgggattttggtacgctgagcagcaatagctgctgcgtgcggggcaggaattggacgacgcgccggcggaccaggtgggtttgagcagcagctggccatctgcagctcagcttatcggagaactccgccgagccgatttcgcccgacactggttcggtagaggtgcatggaggtattcagcgcattagcctccgcggttcgatgctgatgccgccgcaatccaactggcaggacaatcggttcagcagtgtcgcggcacaggtcgacgttcctcgcgcccacattcgcggtcatgcaaggttctccatctgacttgcgcaacaggacttttcgacattccagccgatgaagacagctttgcagcgcgacaaccaagatgagacgccagcggcaagcacgaccaggtcgtcgattatcggcatgtcatccattcgctgcgcaaaaagccgatggcgctccttcagcttgtctatcgcgacaagctgtttccgcggcaggaataccgaagggccttcgagaccctgctcgaccggctttccgacaagcaggcctgcaagatcaccgtcgagctcttggccttggcccacgatcggggctgcgagcgggaactggcagagcggctcgctaaaacactcgatgcggacgaactgccggacatcatcgcgctgaggactttcttcgcgcccgatccggcacagttgcccaccgtcaacgttcgtctcgcctccctccagggctatgaggccctgatcgacgcgcgtcatctggaggacgccgcatgaaaaacgcccctgccatcgacgccgccacgctcagcacgctgcgcaatgaactccgccttccggccatcaaggtcctttggccggactttgccgaacgggccgacaaggaggggtggccagcggcccggttcctgtcggtgatcgccgagcacgaactggccgaacgcgatcgccgccgcatcgaacgccatctcgccgaggcgcgattgccaccgggaaagacgctcgacagctttgacttcgacgccgtgccgatggtctccaaggcacaggtcatggcgatcgccgccgggcgatagctggctcgccaagggagcgaacatcctgttgttcggcccgcccggtggcggcaagagccatctcgccgccgcaatcggcctcgcgctcatcgagaacggttggcgggtgctgttcatgcgtacgaccgagctcgttcagaagctgcaggtggcacgtcgtgaactccagctcgaatccgccatcgccacgaagcccaaccgacatggacagtcgcgctgcgctgcgggcagcgatcgagacagcttcaacgacagaccagggtcaacgatcgcaaaaacaatcagtgctacgtaccgggtacgccgggccctgctgccaatggcaaccgtgatcgaacgcatgggttgtcggcccgcgccattgcccggcgtcgtgcctaggcagctctgatcggagctgacgcttacgcgctcgagatcgatcctcgcttgcaggccccgcatccggtctggggggtgggacatccgggagggtgacgccacttagcctggctcgctggtgacttcaacgccagccgtcggtacgcgacagtcataacgcaggcatcaaactccgccagaagctcactgatgacgcggcagacgatgttcatcaagccaatcggctgcctgctctcgcaggtcaacaaccgcaaaatgcagcgccatatgaacgctcgcatagaaacatctaaggcgctgtgactgttcctcgccgcgatttttggcccctgcaggctgccaatgacgccgatgaagatgcgatcgggactatagaccggaaagtcgctgacaccggctgctgcagatcaagcccggtcttgaggggatggtggagaaaggggaggtatcgcctctggtgatagcgaccagcaacgagcacacgttcgtaagctcgcgggaggcttccttccaggcgttcacgttcgactcgccccgggggctatagacgaacaccttatgcccaagcccgactgagtgagcatgttacatgttcatccacggtatggatgatagctatgcaaaaactcgatttttccattctcgcgaaattcgattaagaaactcgtacaggttggaggcagagtggacagtcagacaccggccacgcagatatgattggcaatccgtccgcggatgcattgaggcaggcttcatgagcgaattcaagtggggtcacattcgcggcgatctgaattctcggctccccagctatagccgcaggcagcgcaatctcgggtgctcacccgtacgtgcgtgccctccagtacatcacaagccctcgcttggtttagctcggtgcgacggaaatcgacaggcgccgccgccgagggtgctgaattggcgcaactggcagattcatgaggcacttgtttgaaagcaaagctcggtcgatctattggccgcttcggcgacgagcggggcaacatagctgttctttgctttacaacggcagcgcaacgccgaacccgccaagcgttttttgaggagacctgctccggcttgagttcggaagacacttcccgagacactgcatcgccaggtaacgcatctcatcggctccgttgaagctcagtttatcgcgggtgccatcttgtggcccacaaacaccacttacgaggagaagacatcaatggatcagcccgcttggaagaatccgcgtacggccctgatcgtcgatggcagtgacgctgcacgtcaacggcgtataccgaatctggcgtcggtcgacctaaacctgctagtggagctcgaggccttattgcagtatcgaaacatcacgcatgcggctcaacatgtcggtaggagccaaccggcaatgagtagagccctatcaaggctgcgtgacatgttcaatgacgatctcttggtacgcggctcgagtggcctagtcccaacaccgcaggccgaacacttggcgcaaatgctgccgtcggtattgaatgctatccgcgaactggtgagctgcagttccggcttaagggatttgcggtcgaaggtaactatggcaatgcccgatcaccaatcgctagttctgctgccatatctattgccgcgtttaggtgagcgtgtgcctcatgttgacatcgtcaccgagccacttttggacggcgctctacggcgtctcgagcaaggtgagattgactttgcgatcgggcagattggtgccgctcctccaggctacttgcggcgcggtctctatgcggaccgcttcacttgcctgcttcgccacgaccaccctgcattagagcaggagtggagcgtcggaaccttcgcggcgctgcgtcacgcctctattgcctcggattccaacgagggcctgggtcaagtctatgatgggctggtcaggttcggactacccggtccgatagtggtctccaacgtgctgactgcggcagttgtagtggcgatgactgacctagtgctgatgataccgaaccgagttgcaactcgggtggcgactatgctgccgctcgctattgtagatccacccgtggagctgaagccatacgaagttgcgttgatctggcaccagcgctgccatcatgacttggaacatcgcgtgctgcgtcgcgaaatcgccgccgcagcgcggatgggccggctagacgtgtcacaagaccaaagggcgaggcggcagaacgatagttgaactcaccgctgaacggaagggtgcagcgaaggacagcccgacaccgcgtgcgattgatcccatcaagcgccgggtgtttgacgctttagcttcctcaaggcatcagttcatctcggggttctcgctgccatgtcatcgcactcgccgtggacgctggcgccactctgctaagtgccgctttgcatcgtcaacatttgacctatattgcactgcaacaatggtaggcttgcctgatccaccattatggtcacaggttcccttcaagcgggaacgcgcgctcgctgcgcacgatagaaggagttccatctcatgaaaaatttaatccacaacgtgggcccaaacgacgcccgtagggaccacgtcgatataggtgatgcggttcggcgatctcgcgaagcggtcggatatagcgtcgacgacctcgcattaacatgcggtctgacatgcgccgaaatttcaaggatcgaattaggtgctgatgtcgaccctgaacggctcaggcgtgtagtcgctgcccttcgagtgccagccaccaccttcgcattgaaacattcatgaacagcattcagtggaaacaagctccgcaagctcgagtatagtccccgacgcgattgccacctatgccgacaccctcatttcaataggtggcgtacagtcgaaccacacgcggagtgtcgctgcggttgcagcgaagaccggcatgaaatgcctcctggttcagaacagttgtgccatcggccgtgatacacgacccggcgcttctgcattcctatgcacatcaatccagccgagaacatctcggtatctgtgcgagaacgacttcaccatctgcgtcggcggcgaaatcatcgataaatcagtcaggcctggaacctcttcgtcaacaacaaagtgcttcgtcacctccataaagtcaggcaaatgggcgcaggtgaaaacttaaatgcaatcgagtcgacattcaccctcacgagttctcctaacgaccaaactcttctcatcaaacgttcgtgctcctcaagttccggtaccgtgctaatgcccagagcggaaagaacttggagtagccgtgatatcgcaaataaaacacccgcggaaaacccgtggcggtgtagcgctgctcatcccacagaccgttctcggtttgtgcgttttttaggtagttcaccccgcgtgcgacggccggatgctccacctcgccggccgccatcagtccaagcaaggcccacgccgtttgggaggacgtggaaggcgcctgctcatatccgctatagtcgagtcggtagctgattgcatcctcgccccaaccgccgtcccaactctggatggatactagccattccaccgccttccttatcatggggtcttggtgatcgatccctgcggcattcagcgcgcacaacaccgaccaggtaccgtagatgtagttcaggccccagcggccgtaccatgatccttccgcgtgttgggtgcggcgcaaatatgcaatcccctcggcgactgccttgctcctttgggtgaattcgccgacctgggccaacatcgagacgcaccgtgcggtaacgtcttcggtcggcgggtcgagcagcgcgccatggtccgcgaatgggaggttattcaggtagtattcgagattgttgacgtcgaaggcggcccagccgccatcccggctttgcatgccttcgatccattcccggccacgtgcgatcgcggtggcgtattccttgctgccggcgtgccgctgcgcgcggtccatggccatgaccaccactgcagtgtcatcgagatcgggatagtgcgcgttgttgtattgaaacggccagccgccgggcctgatgttgggcgccttcactgcccagtcgcccttcacgtccagtacctgccgcggcttcagccagtccaggccctgcttcgctttcgccacggcgttagcgccgcccacctcctgaagtgcgtggcacgtcagcgcggtgtcccagaccggcgacaggcagggctggcaataggcctcttcctcgccgatcaccaagagcttgtcaatagcgcgacgtgctatcgcgcgcggcggaaaatgatcgtctttaccgagcgcgtcatacatcatcacgatattggccatcgacggatagatcgcgcccatgccatcttcaccgttgagccgctcttcagtgaaggcgagcgcactcgcgatcgcgcgctcacgaagtttcttcggaagatgcggctcaataacccgcaggatgccgtcgatgccgcggaacagcaagaaccagccccagctctggtgcggcgccttcgggttcatgcctacgctcttggtatcctgaaggaacagttcttcgatgccgacgcccttaggattcttcgcacgcggcttcagcactgcaagaaccatcagcggcacaatagtggtgcgcgcccagtaggagatcttgtagaggtggaacggcgaccagattggcagtagcac

What is claimed is:

1. An isolated polynucleotide open reading frame (ORF) y4gA to y4gN derived from the polynucleotide sequence of SEQ ID NO: 1 at nucleotide base numbers 142,026 to 143,234 and degenerate variants thereof.

2. The ORF of claim 1 which is under the control of its natural regulatory elements.

3. A plasmid which harbours the ORF of claim 1 or any degenerate variant thereof.

4. The plasmid of claim 3 produced recombinantly.

5. A method for transforming a microorganism, comprising the step of transforming the microorganism with the plasmid of claim 3.

6. A method for transforming a plant, comprising the step of transforming the plant with a shuttle vector comprising the plasmid of claim 3.

7. A method for transforming a plant, comprising the step of transforming the plant with the plasmid of claim 3.

8. A transgenic plant, transformed with the ORF of claim 1.

9. A transgenic microorganism, transformed with the ORF of claim 1.

* * * * *